United States Patent
Donaldson et al.

(10) Patent No.: US 8,273,558 B2
(45) Date of Patent: *Sep. 25, 2012

(54) FERMENTIVE PRODUCTION OF FOUR CARBON ALCOHOLS

(75) Inventors: Gail K. Donaldson, Newark, DE (US);
Andrew C. Eliot, Wilmington, DE (US);
Dennis Flint, Newark, DE (US); Lori Ann Maggio-Hall, Wilmington, DE (US); Vasantha Nagarajan, Wilmington, DE (US)

(73) Assignee: Butamax(TM) Advanced Biofuels LLC, Wilmington, DE (US)

( * ) Notice: Subject to any disclaimer, the term of this patent is extended or adjusted under 35 U.S.C. 154(b) by 0 days.

This patent is subject to a terminal disclaimer.

(21) Appl. No.: 12/966,333

(22) Filed: Dec. 13, 2010

(65) Prior Publication Data

US 2011/0313206 A1    Dec. 22, 2011

Related U.S. Application Data

(66) Continuation-in-part of application No. 11/586,315, filed on Oct. 25, 2006, now Pat. No. 7,851,188, and a continuation-in-part of application No. 12/110,526, filed on Apr. 28, 2008, and a continuation-in-part of application No. 12/477,942, filed on Jun. 4, 2009, Substitute for application No. 61/058,970, filed on Jun. 5, 2008.

(60) Provisional application No. 60/730,290, filed on Oct. 26, 2005, provisional application No. 60/915,467, filed on May 2, 2007.

(51) Int. Cl.
*C12P 21/06* (2006.01)
*C12P 7/04* (2006.01)
*C12P 7/16* (2006.01)
*C12N 9/00* (2006.01)
*C12N 1/20* (2006.01)
*C12N 1/00* (2006.01)
*C12N 15/00* (2006.01)
*C07H 21/04* (2006.01)

(52) U.S. Cl. ....... 435/160; 435/69.1; 435/157; 435/183; 435/252.3; 435/254.22; 435/320.1; 536/23.2

(58) Field of Classification Search .................. None
See application file for complete search history.

(56) References Cited

U.S. PATENT DOCUMENTS

| | | | |
|---|---|---|---|
| 2,198,104 A | 4/1940 | Carnarius | |
| 4,424,275 A | 1/1984 | Levy | |
| 4,520,104 A | 5/1985 | Heady et al. | |
| 4,568,643 A | 2/1986 | Levy | |
| 4,683,202 A | 7/1987 | Mullis | |
| 5,063,156 A | 11/1991 | Glassner et al. | |
| 5,192,673 A | 3/1993 | Jain et al. | |
| 5,210,032 A | 5/1993 | Kashket | |
| 5,210,296 A | 5/1993 | Cockrem et al. | |
| 5,424,202 A | 6/1995 | Ingram et al. | |
| 5,686,276 A | 11/1997 | Laffend et al. | |
| 6,013,494 A | 1/2000 | Nakamura et al. | |
| 6,177,264 B1 | 1/2001 | Eggeling et al. | |
| 6,358,717 B1 | 3/2002 | Blaschek et al. | |
| 6,579,330 B2 | 6/2003 | Nakahama et al. | |
| 6,586,229 B1 | 7/2003 | Ben-Bassat et al. | |
| 6,660,507 B2 | 12/2003 | Cheng et al. | |
| 6,787,334 B1 | 9/2004 | Elischweski et al. | |
| 6,960,465 B1 | 11/2005 | Papaoutsakis et al. | |
| 7,632,663 B1 | 12/2009 | Eggeling et al. | |
| 7,851,188 B2 * | 12/2010 | Donaldson et al. | 435/160 |
| 7,993,889 B1 * | 8/2011 | Donaldson et al. | 435/157 |
| 8,017,375 B2 | 9/2011 | Feldman et al. | |
| 2002/0028492 A1 | 3/2002 | Lenke et al. | |
| 2004/0146996 A1 | 7/2004 | Yocum et al. | |
| 2004/0234649 A1 | 11/2004 | Lewis et al. | |
| 2004/0248250 A1 | 12/2004 | Nakai et al. | |
| 2005/0059136 A1 | 3/2005 | van Maris et al. | |
| 2005/0112739 A1 | 5/2005 | Golubkov et al. | |
| 2007/0031950 A1 | 2/2007 | Winkler | |
| 2007/0092957 A1 | 4/2007 | Donaldson et al. | |
| 2007/0259410 A1 | 11/2007 | Donaldson et al. | |
| 2007/0259411 A1 | 11/2007 | Bramucci et al. | |
| 2007/0292927 A1 | 12/2007 | Donaldson et al. | |
| 2008/0124774 A1 | 5/2008 | Bramucci et al. | |
| 2008/0138870 A1 | 6/2008 | Bramucci et al. | |
| 2008/0182308 A1 | 7/2008 | Donaldson et al. | |
| 2008/0261230 A1 | 10/2008 | Liao et al. | |
| 2008/0274524 A1 | 11/2008 | Bramucci et al. | |
| 2009/0155870 A1 | 6/2009 | Donaldson et al. | |
| 2009/0163376 A1 | 6/2009 | Li et al. | |
| 2009/0226991 A1 | 9/2009 | Feldman et al. | |
| 2009/0269823 A1 | 10/2009 | Bramucci et al. | |
| 2009/0305363 A1 | 12/2009 | Anthony et al. | |
| 2010/0081182 A1 | 4/2010 | Paul et al. | |

(Continued)

FOREIGN PATENT DOCUMENTS

AU    620802    2/1992

(Continued)

OTHER PUBLICATIONS

Genbank NC_001144.4.
Genbank NC_002754.1.
Genbank NC_003364.1.
Genbank NC_003295.1.
Genbank NC_002516.
Genbank NC_004129.
Genbank ZP_01224863.1.
Genbank O82043.
Genbank NC_000913.
Genbank NP_977840.1.
GenBank No. AAA25161.
GenBank No. AAA65614.
GenBank No. AAA65615.
GenBank No. AAA65617.

(Continued)

*Primary Examiner* — Christian Fronda
(74) *Attorney, Agent, or Firm* — Christine M. Lhuller

(57) ABSTRACT

Methods for the fermentative production of four carbon alcohols is provided. Specifically, butanol, preferably isobutanol is produced by the fermentative growth of a recombinant bacterium expressing an isobutanol biosynthetic pathway.

20 Claims, 1 Drawing Sheet

U.S. PATENT DOCUMENTS

| | | | |
|---|---|---|---|
| 2010/0120105 A1 | 5/2010 | Anthony et al. |
| 2010/0129886 A1 | 5/2010 | Anthony et al. |
| 2010/0143997 A1 | 6/2010 | Buelter et al. |
| 2010/0197519 A1 | 8/2010 | Li et al. |
| 2011/0020889 A1 | 1/2011 | Feldman et al. |
| 2011/0053235 A1 | 3/2011 | Festel et al. |
| 2011/0160442 A1 | 6/2011 | Pietarinen et al. |
| 2011/0183392 A1 | 7/2011 | Feldman et al. |

FOREIGN PATENT DOCUMENTS

| | | |
|---|---|---|
| CA | 2039245 | 3/1991 |
| EP | 0 112 459 A1 | 7/1984 |
| EP | 0 282 474 A1 | 9/1988 |
| EP | 0 315 949 A2 | 5/1989 |
| EP | 1 149 918 A1 | 4/2000 |
| JP | 61-209594 | 9/1986 |
| JP | 63-17695 | 4/1988 |
| JP | 63-102687 | 5/1988 |
| JP | 63-254986 | 10/1988 |
| WO | WO 90/02193 A1 | 3/1990 |
| WO | WO 98/51813 A1 | 11/1998 |
| WO | WO 00/50624 A1 | 8/2000 |
| WO | WO 01/21772 A2 | 3/2001 |
| WO | WO 2005/040392 A1 | 5/2005 |
| WO | WO 2007/041269 A2 | 4/2007 |
| WO | WO 2007/050671 | 5/2007 |
| WO | WO 2007/061590 | 5/2007 |
| WO | WO 2008/006038 A2 | 1/2008 |
| WO | WO 2008/052991 | 5/2008 |
| WO | WO 2008/072920 A1 | 6/2008 |
| WO | WO 2008/072921 A1 | 6/2008 |
| WO | WO 2009/086423 | 7/2009 |
| WO | WO 2010/151525 | 12/2010 |

OTHER PUBLICATIONS

GenBank No. AAA65618.
GenBank No. AAS49166.
GenBank No. AJ746364.
GenBank No. AY548760.
GenBank No. BX957219 obsolete and replaced by BX950229.
GenBank No. CAB14105.
GenBank No. CAB14334.
GenBank No. CAB14335.
GenBank No. CAB14336.
GenBank No. CAB14337.
GenBank No. CAB15618.
GenBank No. CAF29874.
GenBank No. CAG34226.
GenBank No. L16975.
GenBank No. M57613.
GenBank No. M73842.
GenBank No. NC_001142.
GenBank No. NC_003030.
GenBank No. NC_001136.
GenBank No. NC_001145.
GenBank No. NC_001988.
GenBank No. NC_003197.
GenBank No. NP_012550.
GenBank No. NP_010656.
GenBank No. NP_014051.
GenBank No. NP_149189.
Order Denying Request for Inter Partes Reexamination of U.S. Patent No. 7,851,188, mailed Oct. 27, 2011, U.S. Control No. 95/001,718, filed Aug. 18, 2011.
Petition Under 37 CFR §§ 1.927 and 1.181 for Supervisory Review of Refusal to Order Reexamination for Claims 1-3, 13-15, 17-24, and 34-37, mailed Nov. 28, 2011, U.S. Control No. 95/001,718, filed Aug. 18, 2011.
Decision on Petition Under 37 CFR 1.181 mailed Mar. 5, 2012, U.S. Control. No. 95/001,718, filed Aug. 18, 2011.
Request for Reexamination of U.S. Patent No. 7,851,188, U.S. Control No. 95/001,857, filed Dec. 19, 2011, U.S. Control No. 95/001,857.
Order Granting Request for Inter Partes Reexamination of U.S. Patent No. 7,851,188, mailed Mar. 5, 2012, U.S. Control No. 95/001,857, filed Dec. 19, 2011.
Office Action in Inter Partes Reexamination of U.S. Patent No. 7,851,188, mailed Mar. 5, 2012, U.S. Control No. 95/001,857, filed Dec. 19, 2011.
Petition of Patent Owner Under 37 CFR §§1.181 And/Or 1.183 to Vacate the Order Granting Second Reexamination Request, mailed Mar. 19, 2012, U.S. Control No. 95/001,857, filed Dec. 19, 2011.
Opposition to Petition of Patent Owner Under 37 CFR §§1.181 And/Or 1.183 to Vacate the Order Granting Second Reexamination Request, mailed Apr. 2, 2012, U.S. Control No. 95/001,857, filed Dec. 19, 2011.
Order Granting Request for Inter Partes Reexamination of U.S. Patent No. 7,993,889, mailed Nov. 25, 2011, U.S. Control No. 95/001,735, filed Sep. 1, 2011.
Office Action in Inter Partes Reexamination of U.S. Patent No. 7,993,889, mailed Nov. 25, 2011, U.S. Control No. 95/001,735, filed Sep. 1, 2011.
Response filed Feb. 24, 2012 in Inter Partes Reexamination of U.S. Patent No. 7,993,889, U.S. Control No. 95/001,735, filed Sep. 1, 2011.
Response filed Feb. 27, 2012 in Inter Partes Reexamination of U.S. Patent No. 7,993,889, U.S. Control No. 95/001,735, filed Sep. 1, 2011.
Third Party Requester Comments After Non-Final Office Action, filed Mar. 26, 2012 in Inter Partes Reexamination of U.S. Patent No. 7,993,889, U.S. Control No. 95/001,735, filed Sep. 1, 2011.
"Boosting Biomass-to . . . Butanol?", Green Car Congress, Jul. 20, 2005, available at http://www.greencarcongress.corn/2005/07/boosting_biomass.html.
"Butamax Expands Early Adopters Group As Two New Ethanol Producers Join for Early Access to Biobutanol Production", available at http://www.butamax.com/_assets/pdf/butamax%20announces-%202%20new%20eag%20may%201%202012.pdf, May 1, 2012.
Alasfour, F.N., "NOx Emission from a Spark Ignition Engine using 30% Iso-Butanol-Gasoline Blend: Part 1—Preheating Inlet Air," *Appl. Thermal Eng'g* 18(5):245-56, Elsevier Science Ltd., England (1998).
Alasfour, F.N., "NOx Emission from a Spark Ignition Engine using 30% Iso-Butanol-Gasoline Blend: Part 2—Ignition Timing," *Appl. Thermal Eng'g* 18(8):609-18, Elsevier Science Ltd., England (1998).
Atsumi, S., et al., "Direct photosynthetic recycling of carbon dioxide to isobutyraldehyde," *Nat. Biotechnol.* 27(12):1177-80, Nature Publishing Group, England (2009).
Atsumi, S., et al., "Non-fermentive pathways for synthesis of branched-chain higher alcohols as biofuels," *Nature* 451(7174):86-89, Nature Publishing Group, England (2008).
Äyräpää, T., "Formation of Higher Alcohols From 14C-Labelled Valine and Leucine," J. Inst. Brewing, 73: 17-30, W. Heffer & Sons, Ltd, England (1967).
Bailey, J.E., "Toward a Science of Metabolic Engineering," *Science* 252:1668-1675, American Association for the Advancement of Science, United States (1991).
Boulton, C., et al., Brewing Yeast & Fermentation, Chapter 3, first ed., Blackwell Science Ltd, E. Oxford, United Kingdom, pp. 69-259, 2001.
Brenda Comprehensive Enzyme Information System entry for EC 1.1.1.2 alcohol dehydrogenase (NADP+) in *E. coli*, accessed at www.brenda-enzymes.org, accessed on Jun. 1, 2012, 8 pages.
Carlini et al., "Guerbet Condensation of Methanol with N-Propanol to Isobutanol Alcohol Over Heterogeneous Copper Chromite/Mg-A 1 Mixed Oxides Catalysts," *J Mol. Catal. A: Chem.* 220:215-220, (2004).
Chen, E.C.-H., "Keto Acid Decarboxylase and Alcohol Dehydrogenase Activities of Yeast in Relation to the Formation of Fusel Alcohols," *Can. Inst. Food Sci. Technol. J.* 10:27-30, Canadian Institute of Food Science and Technology, Canada (1977).
Chen, Ph.D. Thesis, McGill University (Montreal, Canada), "Formation and Analysis of Fusel Alcohols in Beer," submitted to the Faculty of Graduate Studies and Research, Department of Agricultural Chemistry, 1978.

Chin, M., "UCLA researchers develop method for production of more efficient biofuels," UCLA Newsroom, Jan. 2, 2008, available at http://newsroom.ucla.edu/portal/ucla/ ucla-engineering-researchers-develop-42502.aspx, UC Regents, United States.

Glassner, D.A., "Hydrocarbon Fuels from Plant Biomass" available at http://www1.eere.energy.gov/biomass/pdfs/Biomass_2009_Adv_Biofuels_II_Glassner.pdf (2009).

Glick, B.R., "Metabolic Load and Heterologous Gene Expression," *Biotechnol. Adv.* 13:247-261, Elsevier Science, Ltd., England (1995).

Hansen, J. and Kielland-Brandt, M.C., "Modification of biochemical pathways in industrial yeasts," *J. Biotechnol.* 49:1-12, Elsevier Science B.V., Netherlands (1996).

Keasling, J.D. and Chou, H., "Metabolic engineering delivers next-generation biofuels," *Nature Biotechnology* 26(3):298-299, Nature Publishing Group, England (2008).

Kispal, G., et al., "Mitochondrial and Cytosolic Branched-chain Amino Acid Transaminases from Yeast, Homologs of the myc Oncogene-regulated Eca39 Protein," *J. Biol. Chem.* 271(40):24458-24464, The American Society for Biochemistry and Molecular Biology, Inc., United States (1996).

Kohlhaw, G.B., "Leucine Biosynthesis in Fungi: Entering Metabolism through the Back Door," *Microbiol. Mol. Biol. Rev.* 67:1-15, American Society for Microbiology, United States (2003).

Lagier, M.J., et al., "Mitochondrial-type iron-sulfur cluster biosynthesis genes (*IscS* and *IscU*) in the apicomplexan *Cryptosporidium parvum*,"*Microbiology* 149:3519-3530, SGM, England (2003).

Lee et al., Metabolic Engineering, first ed., Marcel Dekker, New York, NY, p. 292 (1999).

Llopis, J., et al., "Measurement of cytosolic, mitochondrial, and Golgi pH in single living cells with green fluorescent proteins," *Proc. Natl. Acad. Sci. USA* 95:6803-6808, The National Academy of Sciences, United States (1998).

Magee, P.T. and De Robichon-Szulmajster, H., "The Regulation of Isoleucine-Valine Biosynthesis in *Saccharomyces cerevisiae*," *European J. Biochem FEBS* 3:507-511, Federation of European Biochemical Societies, Germany (1968).

Marobbio, C.M.T., et al., "α-Isopropylmalate, a Leucine Biosynthesis Intermediate in Yeast, is Transported by the Mitochondrial Oxalacetate Carrier," *J. Biol. Chem.* 283(42):28445-28453, The American Society for Biochemistry and Molecular Biology, Inc., United States (2008).

Omura, F., "Targeting of mitochondrial *Saccharomyces cerevisiae* ILv5p to the cytosol and its effect on vicinal diketone formation in brewing," *Appl. Microbiol. Biotechnol.* 78:503-513, Springer-Verlag, Germany (2008).

Oshita et al., "Clarification of the relationship between fusel alcohol formation and amino acid assimilation by brewing yeast using 13C-labeled amino acid," Proceedings of the European Brewery Convention Congress, pp. 387-394 (1995).

Outten, C.E. and Culotta, V.C., "Alternative Start Sites in the *Saccharomyces cerevisiae GLR1* Gene Are Responsible for Mitochondrial and Cytosolic Isoforms of Glutathione Reductase," *J. Biol. Chem.* 279(9):7785-7791, The American Society for Biochemistry and Molecular Biology, Inc., United States (2004).

Polaina, J., "Cloning of the *ILV2, ILV3,* and *ILV5* Genes of *Saccharomyces cerevisiae*," Carlesberg *Res. Commun.* 49:577-584, Springer-Verlag, Germany (1984).

Popuri, S.S.S. and Bata, R.M., "A Performance Study of Iso-Butanol-, Methanol-, and Ethanol-Gasoline Blends Using a Single Cylinder Engine," Truck Alternative Fuels and Exhaust Gas Emission, SP-1001, 932953, pp. 41-60, The Society of Automotive Engineers, Inc., United States (1993).

Rainbow, C., in *The Yeasts*, vol. 5, Rose, A.H. and Harrison, J.S., eds., pp. 190-199, Academic Press, United States (1970).

Reazin, G., et al., "Mechanism of Major Congener Formation in Alcoholic Grain Fermentations,"*J. Agr. Food Chem.* 18(4):585-589, American Chemical Society, United States (1970).

Ryan, E.D. and Kohlhaw, G.B., "Subcellular Localization of Isoleucine-Valine Biosynthetic Enzymes in Yeast," *J. Bacteriol.* 120(2):631-637, American Society for Microbiology, United States (1974).

Sarthy, A.V., et al., "Expression of the *Escherichia coli* Xylose Isomerase Gene in *Saccharomyces cerevisiae*," *Appl. Environ, Microbiol.* 53(9):1996-2000, American Society for Microbiology, United States (1987).

Schulthess, D. and Ettlinger, L., "Influence of the Concentration of Branched Chain Amino Acids on the Formation of Fusel Alcohols," *J. Inst. Brew.* 84:240-243, W. Heffer & Sons, Ltd, England (1978).

Stephanopoulos, G.A. et al., in Metabolic Engineering Principles and Methodologies, pp. 1-15 and 26-37, Academic Press, United States (1998).

The Presidential Green Chemistry Challenge Awards Program: Summary of 2010 Award Entries and Recipients, United States Environmental Protection Agency, 58 pages.

U.S. Appl. No. 61/016,483, Feldman et al., filed Dec. 23, 2007.

Velasco, J.A. et al., "Cloning of the dihydroxyacid dehydratase-encoding gene (*ILV3*) from *Saccharomyces cerevisiae*," *Gene* 137:179-185, Elsevier Science B.V., Netherlands (1993).

Walker, G.M., "Yeast Technology," in Yeast Physiology and Biotechnology, John Wiley & Sons, Ltd, Chichester, England, pp. 265-320 (1998).

Watanabe et al., "Mutants of bakers' yeasts producing a large amount of isobutyl alcohol or isoamyl alcohol, flavour components of bread," *Applied Microbiology and Biotechnology* 34:154-159, Springer-Verlag, Germany (1990).

Webb, A.D. and Ingraham, J.L., "Fusel Oil" in Advances in Appl. Microbiol., vol. 5, pp. 317-353, Academic Press Inc., England (1963).

Yoshizawa et al., "The Formation of Higher Alcohols in the Fermentation of Amino Acids by Yeast. The Formation of Isobutanol and Isoamyl Alcohol from Pyruvic Acid by Washed Yeats Cells," *Agricultural and Biological Chemistry* 29:672-677, Agricultural Chemical Society of Japan, Japan (1965).

English language abstract for JP 63-017695, File 347, Accession No. 2400795, Derwent WPI English language abstract for JP 63-017695, published Jan. 25, 1988.

English language abstract for JP 63-254986, File 347, Accession No. 2638086, Derwent WPI English language abstract for JP 63-254986, published Oct. 21, 1988.

English language abstract for JP 63-102687, File 347, Accession No. 2485787, Derwent WPI English language abstract for JP 63-102687, published May 7, 1988.

English language abstract for JP 61-209594, File 347, Accession No. 1995494, Derwent WPI English language abstract for JP 61-209594, published Sep. 17, 1988.

Stephanopoulos Preliminary Injuction Hearing Transcript, pp. 114-117, *Butamax™ Advanced Biofuels LLC* v. *Gevo, Inc.*, Case 11-054-SLR-MPT, U.S. District Court for the District of Delaware, Mar. 1, 2012.

Third Party Requester Declaration of Dr. Stephanopoulos, filed Nov. 28, 2011, U.S. Control No. 95/001,718, filed Aug. 18, 2011.

Reeximation Terminated, mailed May 23, 2012, U.S. Control No. 95/001,718, filed Aug. 18, 2011.

Patent Owner Declaration of Professor Klibanov, filed Feb. 24, 2012, U.S. Control No. 95/001,735, filed Sep. 1, 2011.

Third Party Requester Declaration of Dr. Stephanopoulos After Patent Owner Response to Non-Final Office Action, filed Mar. 26, 2012, U.S. Control No. 95/001,735, filed Sep. 1, 2011.

Third Party Requester Declaration of Dr. Porter After Patent Owner Response to Non-Final Office Action, filed Mar. 26, 2012, U.S. Control No. 95/001,735, filed Sep. 1, 2011.

Zaworski, F., ed., "US Oxo-alcohols sinking lower." *ICISpricing Oxo-Alcohols*, Jun. 22, 2012, 2 pages, Reed Business Information Limited, England.

Kwiatkowski, J.R., et al., "Modeling the process and costs of fuel ethanol production by the corn dry-grind process," *Industrial Crops and Products* 23:288-296, Elsevier B.V., Netherlands (2006).

Natural Gas Weekly Update for Week Ending Jun. 27, 2012, Release Date Jun. 28, 2012, U.S. Energy Information Administration, 10 pages, accessed at http://205.254.135.7/naturalgas/weekly.

Bevill, K., et al., "Proposed Ethanol Plant List: 2008 United States & Canada PART 1," Ethanol Producer Magazine, EthanolProducer.com Apr. 1, 2008, 9 pages, accessed at http://www.ethanolproducer.com/articles/3851/proposed-ethanol-plant-list-2008-united-states-and-canada-part- 1.

"Who Shall Dare: Biobutanol and the intrepid ethanol producer," Biofuelsdigest.com, Jun. 22, 2012, Biofuels Digest, Unites States, 4 pages, accessed at http://biofuelsdigest.com/bdiges/2012/06/22//who=shall-dare-biobutanol-and-the-intrepid-ehtanol-producer/.

Patent Owner Response filed Jun. 6, 2012 in Inter Partes Reexamination of U.S. Patent No. 7,851,188, U.S. Control No. 95/001,857, filed Dec. 19, 2011.

Patent Owner Declaration of Professor Klibanov, filed Jun. 5, 2012 in Re-examination of U.S. Patent 7,851,188, U.S. Control No. 95/001,857, filed Dec. 19, 2011.

Patent Owner Declaration of Larry C. Anthony, filed Jun. 5, 2012 in Reexamination of U.S. Patent 7,851,188, U.S. Control No. 95/001,857, filed Dec. 19, 2011.

Third Party Requester Declaration of Dr. Stephanopoulos, filed May 25, 2012, U.S. Control No. 95/001,998, filed May 25, 2012.

Äyräpää, T., "The Formation of Phenethyl Alcohol from $^{14}$C-Labelled Phenylalanine," *J. Inst. Brewing* 71:341-347, W. Heffer & Sons, Ltd, England (1965).

Äyräpää, T., "Formation of Higher Alcohols by Varous Yeasts," *J. Inst. Brewing* 74:169-178, W. Heffer & Sons, Ltd, England (1968).

Causton, H.C., et al., "Remodeling of Yeast Genome Expression in Response to Environmental Changes," *Mol. Biol. Cell* 12:323-337, The American Society for Cell Biology, United States (2001).

Blombach, B., et al.,"*Corynebacterium glutamicum* Tailored for Efficient Isobutanol Production," *Appl. Environ. Microbiol.* 77(10):3300-3310, The American Society for Microbiology, United States (2011).

Trinh, C.T., et al., "Redesigning *Escherichia coli* Metabolism for Anaerobic Production of Isobutanol," *Appl. Env. Microbiol.* 77:4894-904, American Society for Microbiology, United States (2011).

Kolkman, A., et al., "Comparative Proteome Analysis of *Sacchromyces cerevisiae* Grown in Chemostat Cultures Limited for Glucose or Ethanol," *Mol. Cell. Proteom* 4:1-11, The American Society for Biochemistry and Molecular Biology, Inc., United States (2005).

Boer, V.M., et al., "The Genome-wide Transcriptional Responses of *Saccharomyces cerevisiae* Grown on Glucose in Aerobic Chemostat Cultures Limited for Carbon, Nitrogen, Phosphorus, or Sulfur," *J. Biol. Chem.* 278:3265-3274, The American Society for Biochemistry and Molecular Biology, Inc., United States (2003).

Frodyma, M.E. and Downs, D., "ApbA, the Ketopantoate Reductase Enzyme *Salmonella typhimurium* is Required for the Synthesis of Thiamine via the Alternative Pyrimidine Biosynthetic Pathway," *J. Biol. Chem.* 273:5572-76, The American Society for Biochemistry and Molecular Biology, Inc., United States (1998).

Inoue, T., "Mechanism of Higher Alcohol Formation During Wort Fermentation by Brewer's Yeast," *Rept. Res. Lab. Kirin Brewery Co* 18:13-16, The Research Laboratories of Kirin Brewery Co., Ltd., Japan (1975).

Hammond, J.R.M., "Brewer's Yeasts," in The Yeasts, vol. 5, $2^{nd}$ Edition, Rose, A.H. and Harrison, J.S., eds., pp. 7-67, Academic Press, United States (1993).

Chen, E. C.-H., "The Relative contribution of Ehrlich and Biosynthetic Pathways to the Formation of Fusel Alcohols," *J. Amer. Soc. Brewing Chem.* 36(1):39-43, American Society of Brewing Chemists, Inc., United States (1978).

Norbeck et al., "Metabolic and regulatory changes associated with growth of *Saccharomyces cerevevisiae* in 1.4 M NaCL Evidence for osmotic induction of glycerol dissimilation via the dihydroxyacetone pathway," *J Biol Chem.* 272(9):5544-54, American Society for Biochemistry and Molecular Biology, United States (1997).

Japanese Patent Application No. JP 2000-041655 A, with unverified English-Language Translation.

Kotula, L and Curtis, P.J., "Evaluation of Foreign Gene Codon Optimization in Yeast: Expression of a Mouse IG Kappa Chain," *Nature Biotechnolgogy* 9:1386-1389, Nature Publishing Group, England (1991).

Kassow, A., Metabolic effects of deleting the region encoding the transit peptide in *Saccharomyces cerevisiae ILV5*, Thesis for the Cand. Scient. Degree at Institute of Genetics, University of Copenhagen, Department of Yeast Genetics, 48 pages, Denmark (1992).

Eden, A., et al., "Involvement of branched-chain amino acid aminotransferases in the production of fusel alcohols during fermentation in yeast," *Appl. Microbiol. Biotechnol.* 55:296-300, Springer-Verlag, Germany (2001).

Third Party Requester Comments After Patent Owner Response to Non-Final Office Action, filed Jul. 5, 2012, in Inter Partes Reexamination of U.S. Patent No. 7,851,188, U.S. Control No. 95/001,857, filed Dec. 19, 2011.

Third Party Declaration of Dr. Glassner, filed Jul. 5, 2012, U.S. Control No. 95/001,857, filed Dec. 19, 2011.

Chen, et al., "Increased isobutanol production in *Saccharomyces cerevisiae* by overexpression of genes in valine metabolism," *Biotechnol. Biofuels* 4(21):1-12, BioMed Central Ltd., England (2011).

Hammond, J. R.M., "Genetically-modified brewing yeasts for the 21st century. Progress to date," *Yeast* 11(16):1613-27, John Wiley & Sons Ltd, United States (1995).

U.S. Appl. No. 60/900,477, Liao et al., filed Feb. 9, 2007.

U.S. Appl. No. 60/900,546, Liao et al., filed Feb. 9, 2007.

"Diet beer offers a slim hope," http://www.independent.co.uk/news/diet-beer-offers-a-slim-hope-1305762.html, The Independent Newspaper, Apr. 20, 1996.

Herman, R.G., "Advances in catalytic synthesis and utilization of higher alcohols," *Catalysis Today* 55(3):233-245, Elsevier B.V., Netherlands (2000).

Olson, E.S., et al., "Higher-alcohols biorefinery: Improvement of catalyst for ethanol conversion," *Appl. Biochem. Biotechnol.* 113-116:913-932, Humana Press, United States (2004).

Sheldon-Coulson, "Production of Levulinic Acid in Urban Biorefineries," M.S. Thesis., Sep. 12, 2011, 84 pp., Massachusetts Institute of Technology, United States.

Sequence Alignment provided with Third Party Requester's Comments After Patent Owner Response to Non-Final Office Action, filed Jul. 5, 2012, in Inter Partes Reexamination of U.S. Patent No. 7,851,188, U.S. Control No. 95/001,857, filed Dec. 19, 2011.

Presecan, E., "The *Bacillus subtilis* genome from gerBC (311°) to licR (334°)," *Microbiology* 143:3313-3328, SGM, England (1997).

Bolotin, A., "The Complete Genome Sequence of the Lactic Acid Bacterium *Lactococcus lactis* ssp. *lactis* IL1403," *Genome Res.* 11(5):731-753, Cold Spring Harbor Press, United States (2001).

Pretorius, I.S., et al., "Designer Yeasts for the Fermentation Industry of the 21st Century," *Food Technol. Biotechnol.* 41(1):3-10, Journal of the Faculty of Food Technology and Biotechnology, Croatia (2003).

Alberts, et al., "Chapter 3. Macromolecules: Structure, Shape and Information," in *Molecular Biology of the Cell*, $3^{rd}$ Ed., pp. 134-135, Garland Publishing, United States (1994).

Third Party Requester Declaration Dr. Stephanopoulos, filed Jul. 5, 2012, U.S. Control No. 95/001,857, filed Dec. 19, 2011.

"Gevo Announces Successful Startup of World's First Commercial Biobased Isobutanol Plant," Gevo Investor Relations News Release, May 24, 2012 2 pages, accessed at www. http://ir.gevo.com/phoenix.zhtml?c=238618&p=irol-newsArticle&ID=1699401&highlight=.

De Kok, S., et al., "Energy coupling in *Saccharomyces cerevisiae*: selected opportunities for metabolic engineering," *Federation of European Microbiological Societies FEMS Yeast Res* 12:387-397, Blackwell Publishing Ltd., England (2012).

"Agricultural Futures" in The Wall Street Journal Online, U.S Edtion, Thursday, Jun. 28, 2012, 8 pages, accessed at http:/online.wsj.com/mdc/public/page/2_3023-fut)agricultural-futures.html?mod=mdc_c, Dow Jones & Company, Inc., United States.

Request for Reexamination of U.S. Patent No. 8,178,328, U.S. Control No. 95/001,998, Filed May 25, 2012, including, its Appendices and Exhibits.

Memorandum Opinion of District Judge Robinson, in *Butamax*™ *Advanced Biofuels LLC* vs. *Gevo, Inc.*, Case 1:11-cv-00054-SLR, United States District Court for the District of Delaware, dated Jun. 19, 2012; 26 pages.

Bekkaoui, F., et al., "Isolation and structure of an acetolactate synthase gene from *Schizosaccharornyces pombe* and complementation of the *ilv2* mutation in *Saccharomyces cerevisiae*," *Current Genetics 24*: 544-547, Springer-Verlag, Germany, 1993.

Boulton, C., et al., *Brewing Yeast & Fermentation*, Chapter 3, first ed., Blackwell Science Ltd, E. Oxford, United Kingdom, pp. 69-142, 2001.

Card, J.C. and Farrell, L.M., "Separation of Alcohol-Water Mixtures Using Salts" in Technical Reports of Oak Ridge National Laboratory, Chemical Techology Division, Contract No. W-7405-eng-26, 1982.

Derrick, S. and Large, P., "Activities of the enzymes of the Ehrlich Pathway and formation of branched-chain alcohols in *Saccharomyces cerevisiae* and *Candida utilis* grown in continuous culture on valine or ammonium as sole nitrogen source," *J. of General Microbiology 139*:2783-2792, Society for Chemical Microbiology, Great Britain, 1993.

Dickinson, J.R., et al., "An Investigation of the Metabolism of Valine to Isobutyl Alcohol in *Saccharomyces cerevisiae*," *J. Biol. Chem. 273*(40): 25751-25756, The American Society for Biochemistry and Molecular Biology, Inc., United States, 1998.

Dickinson, J.R., et al., "The Catabolism of Amino Acids to Long Chain and Complex Alcohols in *Saccharomyces cerevisiae*," *J. Biol. Chem. 278*:8028-8034, The American Society for Biochemistry and Molecular Biology, Inc., United States, 2003.

Hansen, J., et al.,Topics in Current Genetics, Chapter, 5, vol. 2, J.H. de Winde (Ed.): *Functional Genetics of Industrial Yeasts*, Springer-Verlag Berlin Heidelberg, Germany, pp. 143-170, 2003.

Ishige, T., et al., "Whole organism biocatalysis," *Current Opinion in Chemical Biology 9*:174-180, Elsevier, The Netherlands, 2005.

Larroy, C., et al., "Characterization of the *Saccharomyces cerevisiae YMR318C (ADH6)* gene product as a brand specificity NADPH-dependent alcohol dehydrogenase: relevance in aldehyde reduction," *Biochem J. 361*:163-172, Biochemical Society, Great Britain, 2002.

Larroy, C., et al., "Properties and Functional Significance of *Saccharomyces cerevisiae* ADHVL," *Chemico-Biological Interactions 143-144*: 229-238, Elsevier, The Netherlands, 2003.

*Lehninger Principles of Biochemistry*, 3rd ed., David L. Nelson and Michael M. Cox, Eds., Worth Publishers, New York, NY, pp. 293-294, 2000.

Matak-Vinkovic, D., et al., "Crystal Structure of *Escherichia coli* Ketopantoate Reductase at 1.7 Å Resolution and Insight into the Enzyme Mechanism," *Biochemistry 40*:14493-14500, American Chemical Society, United States, 2001.

Petersen, J.G.L., et al., "The *ILV5* gene of *Saccharomyces cerevisiae* is highly expressed," *Nucl. Acids Res. 14*:9631-9651, IRL Press Limited, England, 1986.

Radmacher, E., et al., "Linking Central Metabolism with Increased Pathway Flux: L-Valine Accumulation by *Corynebacterium glutamicum*," *App. Environ. Micro. 68*: 2246-2250, American Society for Microbiology, United States, 2002.

Renna, M.C., et al., "Regulation of the *Bacillus subtilis alsS, alsD,* and *alsR*Genes Involved in Post-Exponential-Phase Production of Acetoin," *J. Bacteriology 175*:3863-3875, American Society for Microbiology, United States, 1993.

Rosenfeld, E. and Beauvoit, B., "Role of the non-respiratory pathways in the utilization of molecular oxygen by *Saccharomyces cerevisiae*," *Yeast 20*:1115-1144, John Wiley & Sons, Inc., United States, 2003.

Screen capture of http://enzyme.expasy.org/EC/2.2.1.6, the ExPASy Bioformatics Resource Portal Enzyme Nomenclature Database for EC No. 2.2.1.6, ExPASy Proteomics Server [retrieved on Aug. 16, 2011].

Screen capture of http://www.chem.qmul.ac.uk/iubmb/enzyme/EC2/2/1/6.html, the IUBMB Enzyme Nomenclature Database for EC No. 2.2.1.6, [retrieved on Sep. 12, 2011].

Smit, Ph.D. Thesis, Wageningen Universiteit (Wageningen, The Netherlands), *Formation of Amino Acid Derived Cheese Flavour Compounds*, orally defended on Apr. 23, 2004, cataloged into the U.S.D.A. National Agricultural Library system on Oct. 3, 2004.

Catalog Receipt from U.S.D.A. National Agricultural Library of Smit, Ph.D. Thesis, Wageningen Universiteit (Wageningen, The Netherlands), *Formation of Amino Acid Derived Cheese Flavour Compounds*, MARC Record View, 2 pages, indicating date cataloged as 20041003 (i.e., Oct. 2, 2004) via MARC Code "005".

Re-examination Request Control No. 95/001,718, filed on Aug. 18, 2011.

Re-examination Request Control No. 95/001,735, filed on Sep. 1, 2011.

Complaint filed on Jan. 14, 2011 by Plaintiff Butamax™ Advanced Biofuels LLC against Defendant Gevo, Inc. in the United States District Court for the District of Delaware, Case 1:11-cv-00054-SRL-MPT.

Answer to Complaint filed on Mar. 25, 2011 by Defendant Gevo, Inc. in the United States District Court for the District of Deleware, Case 1:11-cv-00054-SRL-MPT.

Amended Complaint filed on Aug. 11, 2011 by Plaintiff Butamax™ against Defendant Gevo, Inc. in the United States District Court for the District of Delaware, Case 1:11-cv-00054-SRL-MPT.

Answer to Amended Complaint filed on Sep. 13, 2011 by Defendant Gevo, Inc. in the United States District Court for the District of Delaware, Case 1:11-cv-00054-SRL-MPT.

Plaintiff's Opening Brief in Support of Its Motion for a Preliminary Injunction (Redacted Version) filed on Sep. 30, 2011in the United States District Court for the District of Delaware, Case 1:11-cv-00054-SRL-MPT.

Wynn, R.M., et al., "Chaperonins groEL and groES promote assembly of heterotetramers (alpha 2 beta 2) of mammalian mitochondrial branched-chain alpha-keto acid decarboxylase in *Escherichia coli*," *J. Biol. Chem. 267*(18):12400-12403, American Society for Biochemistry and Molecular Biology , United States, Jun. 1992.

Atsumi, S., et al., "Acetolactate synthase from *Bacillus subtilis* serves as a 2-ketoisovalerate decarboxylase for isobutanol biosynthesis in *Escherichia coli*," *Appl. Environ. Microbiol. 75*(19):6306-11, American Society for Microbiology, United States (Oct. 2009; Epub.: Aug. 2009).

Seffernick, J.L., et al., "Melamine deaminase and atrazine chlorohydrolase: 98 percent identical but functionally different," *J. Bacteriol. 183*(8):2405-2410, American Society for Microbiology, United States, Apr. 2001.

Yoshimoto, H., et al., "Genetic and physiological analysis of branched-chain alcohols and isoamyl acetate production in *Saccharomyces cervisiae*," *Appl. Microbiol. Biotechnol. 59*(4-5):501-8, Springer International, Germany (Aug. 2002; Epub.: Jun. 2002).

Peng, H.L., et al., "Cloning, sequencing and heterologous expression of a *Klebisella pneumoniae* gene encoding and FAD-independent acetolactate synthase," *Gene 117*(1):125-130, Elsevier Science Publishers B.V., Netherlands, 1992.

De La Plaza, M., et al., "Biochemical and molecular characterization of alpha-ketoisovalerate decarboxylase, an enzyme involved in the formation of aldehydes from amino acids by *Lactococcuslactis*," *FEMS Microbiol. Lett. 238*(2):367-374, Elsevier/North Holland on behalf of the Federation of European Microbiological Societies, England, Sep. 2004.

Ullmann's Encyclopedia of Industrial Chemistry, $6^{th}$ Edition, 5:716-719, 2003.

Carlini et al., "Guerbet Condensation of Methanol with N-Propanol to Isobutanol Alcohol Over Heterogeneous Copper Chromite/Mg-A1 Mixed Oxides Catalysts," *J. Mol. Catal. A: Chem. 220*:215-220, 2004.

Garcia et al., "Fusel Alcohols Production in Beer Fermentation Processes," *Process Biochemistry 29*:303-309, 1994.

Durre, "New Insights and Novel Developments in Clostridial Acetone/Butanol/Isopropanol Fermentation," *Applied Microbiology and Biotechnology 49*:639-648, Springer-Verlag, 1998.

Harris et al., "Characterization of Recombinant Strains of the *Clostridium acetobutylicum* Butyrate Kinase Inactivation Mutant: Need for New Phenomenological Models for Solventogenesis and Butanol Inhibition," *Biotechnology and Bioengineering 67*:1-11, John Wiley & Sons, Inc., 2000.

International Search Report and Written Opinion of corresponding PCT/US2006/041602, European Patent Office, Rijswijk, Netherlands, mailed Apr. 11, 2007.

International Preliminary Report on Patentability of corresponding PCT/US2006/041602, European Patent Office, Rijswijk, Netherlands, mailed May 8, 2008.

International Preliminary Report on Patentability of corresponding PCT/US2008/061855, European Patent Office, Rijswijk, Netherlands, mailed Nov. 12, 2009.

Girbal Regulation of Solvent Production in *Clostridium acetobutylicum* et al., *Trends in Biotechnology* 16:11-16, 1998.

Amartey et al., Effects of Temperature and Medium Composition on the Ethanol Toerance of *Bacillus stearothermophilus* LLD-15, *Biotechnol. Lett.* 13:627-632, 1991.

Herrero et al., Development of Ethanol Tolerance in *Clostridium thermocellum*: Effect of Growth Temperature, *Appl. Enrivon. Microbiol.* 40:571-577, 1980.

Brown et al., The Effects of Temperature on the Ethanol Tolerance of the Yeast, *Saccharomyces uvarum, Biotechnol. Lett.* 4:269-274, 1982.

Van Uden, Effects of Ethanol on the Temperature Relations of Viability and Growth in Yeasts, *CRC Crit. Rev. Biotechnol.* 1:263-273, 1984.

Harada, On the Butanol-Rich Production in Acetone-Butanol Fermentation of Molasses, (Part 2, Temperature) Hakko Kyokaishi, 20:155-156, 1962.

Jones et al., Acetone-Butanol Fermentation Revisited, *Microbiol. Rev.* 50:484-524, 1986.

Baer et al., Effect of Butanol Challenge and Temperature on Lipid Composition and Membrane Fluidity of Butanol-Tolerant *Clostridium acetobutylicum, Applied and Environmental Microbiology and Biotechnology* 53:2854-2861, 1987.

Inui et al., Expression of *Clostridium acetobutylicum* Butanol Synthetic Genes is *Escherichia coli, Applied and Microbiology and Biotechnology* 77:1305-1316, 2008.

Bermejo et al., Expression of *Clostridium acetobutylicum* ATCC 824 Genes in *Escherichia coli* For Acetone Production and Acetate Detoxification, *Applied and Environmental Microbiology* 64:1079-1085, 1998.

Casadei et al., Heat Resistance of *Bacillus cereus, Salmonella typhimurium* and *Lactobacillus delbrueckii* in Relation to pH and Ethanol, *International Journal of Food Microbiology* 63:125-134, 2001.

Cornillot et al., The Genes for Butanol and Acetone Formation in *Clostridium acetobutylicum* ATCC 824 Reside on a Large Plasmid Whose Loss Leads to Degeneration of the Strain, *Journal of Bacteriology* 179:5442-5447, 1997.

Fontaine et al., Molecular Characterization and Transcriptional Analysis of ADHE2, the Gene Encoding the NADH-Dependent Aldehyde/Alcohol Dehydrogenase Responsible for Butanol Production in Alcohologenic Cultures of *Clostridium acetobutylicum, Journal of Bacteriology* 184:821-830, 2002.

Woods, The Genetic Engineering of Microbial Solvent Production, *Tibtech* 13:259-264, 1995.

Ishida et al., The Effect of Pyruvate Decarboxylase Gene Knockout in *Saccharomyces cerevisiae* on L-lactic Acid Production, *Biosci. Biotechnol. Biochem.* 70:1148-1153, 2006.

Skory, Lactic Acid Production by *Saccharomyces cerevisiae* expressing a *Rhizopus oryzae* lactate dehydrogenase gene, *J. Ind. Microbiol. Biotechnol.* 30:22-27, 2003.

Adachi et al., Modification of Metabolic Pathways of *Saccharomyces cerevisiae* by the Expression of Lactate Dehydrogenase and Deletion of Pyruvate Decarboxylase Genes for the Lactic Acid Fermentation at Low pH Value, *J. of Fermentation and Bioengineering,* 86:284-289, 1998.

Bjorkqvist et al., Physiological Response to Anaerobicity of Glycerol-3-Phosphate Dehydrogenase Mutants of *Saccharomyces cerevisiae, Appl. and Environmental Microbiology*, pp. 128-132, Jan. 1997.

Nissen et al., Anaerobic and aerobic batch cultivations of *Saccharomyces cerevisiae* mutants impaired in glycerol synthesis, *Yeast* 16:463-474, 2000.

Abbott et al., Metabolic Engineering of *Saccharomyces cerevisiae* for Production of Carboxylic Acids: Current Status and Challenges, *FEMS Yeast Res.* 9:1123-2236, 2009.

Zelle et al., Malic Acid Production by *Saccharomyces cerevisiae*: Engineering of Pyruvate Carboxylation, Oxaloacetate Reduction, and Malate Export, *Applied and Environmental Microbiology*, pp. 2766-2777, May 2008.

Kiers et al., "Regulation of alcoholic fermentation in batch and chemostat cultures of *Kluyveromyces lactis* CBS 2359," *Yeast*, 14:459-469, 1998.

Bianchi et al., "Efficient homolactic fermentation by *Kluyveromyces lactis* strains defective in pyruvate utilization and transformed with the heterologous LDH gene," *Applied and Environ. Microbiol.*, 67:5621-5625, 2001.

Van Maris et al., "Directed Evolution of Pyruvate Decarboxylase-Negative *Saccharomyces cerevisiae*. Yielding a C2-Independent, Glucose-Tolerant, and Pyruvate-Hyperproducing Yeast," *Applied and Environ. Microbiol.*, 70:159-166, 2004.

Valadi et al., "Improved ethanol production by glycerol-3-phosphate dehydrogenase mutants and *Saccharomyces cerevisiae*," *Appl. Microbiol. Biotechnol.*, 50:434-439, 1998.

International Search Report and Written Opinon of corresponding International Appl. No. PCT/US2009/046226, mailed Apr. 8, 2011.

Methods in Enzymology, Eds. C. Guthrie and G. Fink, Academic Press, Inc. 194:281-301, 1991.

Bellion et al., Microb. Growth C1 Compd. [Int. Symp.], $7^{th}$ (1993), 415-432. Editors: Murrell, J. Collin; Kelly, Don P.; Publisher: Intercept; Andover, UK.

Methods in Yeast Genetics, 2005, pp. 201-202, Cold Spring Harbor Laboratory Press, Cold Spring Harbor, NY.

Voloch et al., Fermentation Derived 2,3-Butanediol, in Comprehensive Biotechnology, Pergamon Press Ltd., England, vol. 2, Section 3:933-947, 1986.

Rychlik, In Methods in Molecular Biology, White, B.A. ed., vol. 15, pp. 31-39, PCR Protocols: Current Methods and Applications. Humania: Totowa, NJ, 1993.

Sambrook et al., Molecular Cloning: A Laboratory Manual, $2^{nd}$ ed., pp. 11.7-11.8, Table 11.1 and pp. 9.50-9.51, Cold Spring Harbor Laboratory: Cold Spring Harbor, NY, 1989.

Altschul et al., *J. Mol. Biol.* 215:403-410, 1990.

Bianchi et al., *Mol. Microbiol.* 19:27-36, 1996.

Deshpande, *Appl. Biochem. Biotechnol.* 36:227, 1992.

Flikweert et al., *Yeast* 12:247-257, 1996.

Frohman et al., *PNAS USA* 85:8998, 1998.

Gollop et al., *J. Bacteriol.* 172:3444-3449, 1990.

Guo et al., *J. Membr. Sci.* 245:199-210, 2004.

Higgins, *CABIOS* 5:151-153, 1989.

Higgins et al., *Comput. Appl. Biosci.* 8:189-191, 1992.

Hohmann, *Mol. Gen. Genet.* 241:657-666, 1993.

Holtzclaw et al., *J. Bacteriol.* 121:917-922, 1975.

Ishida et al., *Biosci. Biotech. and Biochem.* 70:1148-1153, 2006.

Loh et al., *Science* 243:217, 1989.

Neveling et al., *J. Bacteriol.* 180:1540-1548, 1998.

Nevoigt et al., *Yeast* 12:1331-1337, 1996.

Nystrom et al., *J. Am. Chem. Soc.* 69:1198, 1947.

Ohara et al., *PNAS USA* 86:5673, 1989.

Sulter et al., *Arch. Microbiol.* 153:485-489, 1990.

Tabor et al., *PNAS USA* 82:1074, 1985.

Van Ness et al., *Nucl. Acids Res.* 19:5143-5151, 1991.

Wach et al., *Yeast* 10:1793-1808, 1994.

Walker et al., *PNAS USA* 89:392, 1992.

Ausubel et al., Current Protocols in Molecular Biology, published by Green Publishing Assoc. and Wiley Interscience, 1987.

Biocomputing: Informatics and Genome Projects (Smith, D.W., Ed.) Academic: NY, 1993.

Brock, in Biotechnology: A Textbook of Industrial Microbiology, Second Edition, Sinauer Associates, Inc., Sunderland, MA, 1989.

Aden et al., Lignocellulosic Biomass to Ethanol Process Design and Economics Utilizing Co-Current Dilute Acid Prehydrolysis and Enzymatic Hydrolysis for Corn Stover, Report NREL/TP-510-32438, National Renewable Energy Laboratory, Jun. 2002.

Computer Analysis of Sequence Data, Part I, Griffin, A.M. and Griffin, H.D., Eds., Humania: NJ, 1994.

Doherty and Malone, Conceptual Design of Distillation Systems, McGraw Hill, New York, 2001.

Human Genetic Diseases: A Practical Approach, K.E. Davis, Ed., pp. 33-50, IRL: Herndon, VA, 1986.

Manual of Methods for General Bacteriology, Phillipp Gerhardt, R.G.E. Murray, Ralph N. Costilow, Engene W. Nester, Willis A.

Wood, Noel R. Krieg and G. Briggs Phillips, Eds., American Society for Microbiology, Washington, DC, 1994.
Methods in Enzymology, Guide to Yeast Genetics and Molecular and Cell Biology, vol. 194, Part A, Christine Guthrie and Gerald R. Fink, Eds., Elsevier Academic Press, San Diego, CA, 2004.
Sequence Analysis in Molecular Biology, von Heinje, G., Ed., Academic, 1987.
Sequence Analysis Primer, Gribskov, M. and Devereux, J., Ed., Stockton: NY, 1991.
Silhavy et al., Experiments with Gene Fusions, Cold Spring Harbor Laboratory Press, Cold Spring Harbor, NY, 1984.
Spencer et al., Mutagenesis in Yeast, Yeast Protocols: Methods in Cell and Molecular Biology, Humana Press, Totowa, NJ, 1996.
Enzyme Nomenclature, Academic Press, San Diego, 1992.
Computational Molecular Biology, Lesk, A.M., Ed., Oxford University: NY, 1988.
Oaxaca et al., Formation of Ethanol and High Alcohols by Immobilized *Zymomonas mobilis* in Continuous Culture, *Acta Biotechnol.* 11:523-532, 1991.
Eppink et al., Switch of Coenzyme Specificity of p-Hydroxybenzoate Hydroxylase, *J. Mol. Biol.* 292:87-96, 1999.
Nakanishi et al., Switch of Coenzyme Specificity of Mouse Lung Carbonyl Reductase by Substitution of Threonine 38 with Aspartic Acid, *J. Biol. Chem.* 272:2218-2222, 1997.
Kamerbeek et al., Identifying Determinants of NADPH Specificity in Baeyer-Villiger Monooxygenases, *Eur. J. Biochem.* 271:2107-2116, 2004.
Nishiyama et al., Alteration of Coenzyme Specificity of Malate Dehydrogenase From Thermus Flavus by Site-Directed Mutagenesis, *J. Biol. Chem.* 268:4656-4660, 1993.
Martinez-Julvez et al., Towards a New Interaction Enzyme: Coennzyme, *Biophys. Chem.* 115:219-224, 2005.
Rane, Mahhavi et al., Reversal of the Nucleotide Specificity of Ketol Acid Reductoisomerase by Site-Directed Mutagenesis Identifies the NADPH Binding Site, *Arch. Biochem. Biophys.*, 338:83-89, 1997.
Ahn et al., Crystal Structure of Class I Acetohydroxy Acid Isomeroreductase From *Pseudomonas aeruginosa*, *J. Mol. Biol.* 328:505-515, 2003.
Paulsen et al., Complete Genome Sequence of the Plant Commensal *Pseudomonas fluorescens* Pf-5, *Nature Biotech.* 23:873-878, 2005.
International Search Report dated Jul. 6, 2009, International Appl. No. PCT/US2008/087429.
Enzyme Structure and Mechanism, 2$^{nd}$ Ed., Ferst; W.H. Freeman Press, NY, 1985; pp. 98-120.
Abbad-Andaloussi et al., *Microbiol.* 142:1149-1158, 1996.
Arthur et al., *Antimicrob. Agents Chemother.* 38:1899-1903, 1994.

Aulabaugh et al., *Biochemistry* 29:2824-2830, 1990.
Biou et al., *EMBO J.* 16:3405-3415, 1997.
Van Der Geize et al., *Appl. Environ. Microbiol.* 66:2029-2036, 2000.
Chunduru et al., *Biochem.* 28:486-493, 1989.
De Cavalho et al., *Microsc. Res. Tech.* 64:215-222, 2004.
Dürre et al., *FEMS Microbiol. Rev.* 17:251-262, 1995.
Eichenbaum et al., *Appl. Environ. Microbiol.* 64:2763-2769, 1998.
Flemming et al., *Appl. Environ. Microbiol.* 61:3775-3780, 1995.
Flint et al., *J. Biol. Chem.* 268:14732-14742, 1993.
Ford et al., *Yeast* 19:1087-1096, 2002.
Fujimoto et al., *Appl. Environ. Microbiol.* 67:1262-1267, 2001.
Groot et al., *Process Biochem.* 27:61-75, 1992.
Guex et al., *Electrophoresis* 18:2714-2723, 1997.
Hermann et al., *Appl. Environ. Microbiol.* 50:1238-1243, 1985.
Jones et al., *Acta Crystallog. A47*:110-119, 1991.
Kabelitz et al., *FEMS Microbiol. Lett.* 220:223-227, 2003.
Kirill et al., *PNAS USA* 97:6640-6645, 2000.
Kleerebezem et al., *Appl. Environ. Microbiol.* 63:4581-4584, 1997.
Kostichka et al., *Appl. Microbiol. Biotechnol.* 62:61-68, 2003.
Krogh et al., *J. Mol. Biol.* 235:1501-1531, 1994.
Larroy et al., "Characterization of the *Saccharomyces cerevisiae* YMR318C (ADH6) gene product as a broad specificity NADPH-dependent alcohol dehydrogenase: relevance in aldehyde reduction," *Biochem J.* 361:163-172, Biochemical Society, Great Britain, 2002.
Maguin et al., *J Bacteriol.* 174:5633-5638, 1992.
Marinus et al., *Genetics* 63:547-556, 1969.
Nagarajan et al., *Gene* 114:121-126, 1992.
Nakashima et al., *Appl. Environ. Microbiol.* 70:5557-5568, 2004.
Nallaapareddy et al., *Appl. Environ. Microbiol.* 72:334-345, 2006.
O'Sullivan et al., *Gene* 137:227-231, 1993.
Payne et al., *J. Bacteriol.* 173:2278-2282, 1991.
Renault et al., *Gene* 183:175-182, 1996.
Scott et al., *Plasmid* 50:74-79, 2003.
Smit et al., *Appl. Environ. Microbiol.* 71:303-311, 2005.
Sulzenbacher et al., *J. Mol. Biol.* 342:489-502, 2004.
Taghavi et al., *Appl. Environ. Microbiol.* 60:3585-3591, 1994.
Tanimoto et al., *J. Bacteriol.* 184:5800-5804, 2002.
Tao et al., *Appl. Microbiol. Biotechnol.* 68:346-354, 2005.
Thompson et al., *Nuc. Acid Res.* 22:4673-4680, 1994.
Tomas et al., *J. Bacteriol.* 186:2006-2018, 2004.
Tyagi et al., *Protein Sci.* 14:3089-3100, 2005.
Van Kranenburg et al., *Appl. Environ. Microbiol.* 71:1223-1230, 2005.
Wyckoff et al., *Appl. Environ. Microbiol.* 62:1481-1486, 1996.

* cited by examiner

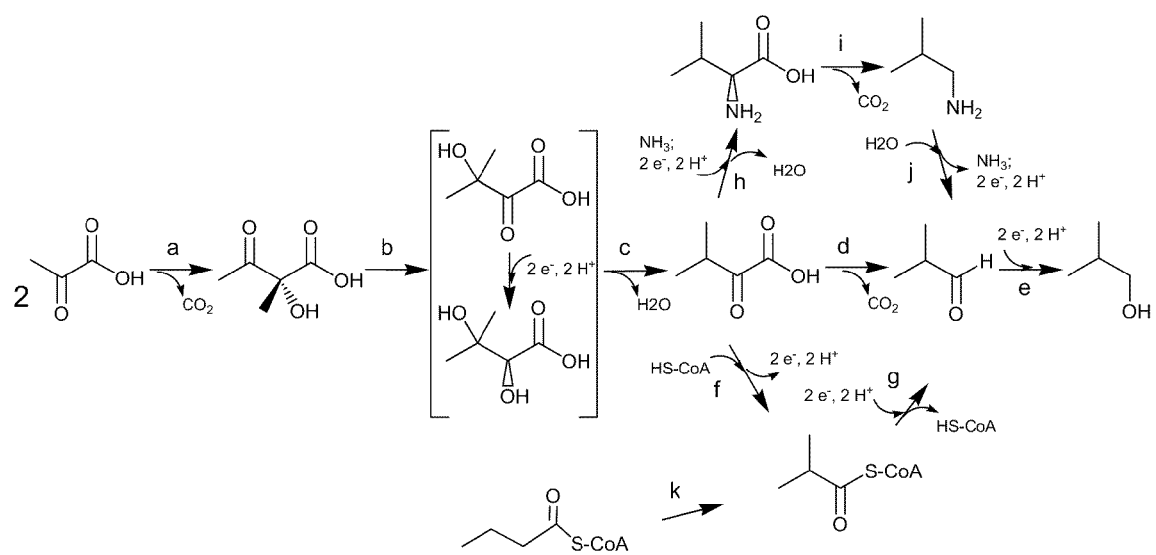

FERMENTIVE PRODUCTION OF FOUR CARBON ALCOHOLS

CROSS-REFERENCE TO RELATED APPLICATIONS

This application is a continuation-in-part of U.S. patent application Ser. No. 11/586,315, filed on Oct. 25, 2006, now U.S. Pat. No. 7,851,188, and which claims priority to U.S. Provisional Application Ser. No. 60/730,290, filed Oct. 26, 2005. This application is also a continuation-in-part of U.S. patent application Ser. No. 12/110,526, filed on Apr. 28, 2008, which claims priority to U.S. Provisional Application Ser. No. 60/915,467, filed on May 2, 2007. This application is also a continuation-in-part of U.S. patent application Ser. No. 12/477,942, filed on Jun. 4, 2009, which claims priority to U.S. Provisional Application Ser. No. 61/058,970, filed on Jun. 5, 2008. The entirety of each of the above referenced applications is herein incorporated by reference.

FIELD OF THE INVENTION

The invention relates to the field of industrial microbiology and the production of alcohols. More specifically, isobutanol is produced via industrial fermentation of a recombinant microorganism.

BACKGROUND OF THE INVENTION

Butanol is an important industrial chemical, useful as a fuel additive, as a feedstock chemical in the plastics industry, and as a foodgrade extractant in the food and flavor industry. Each year 10 to 12 billion pounds of butanol are produced by petrochemical means and the need for this commodity chemical will likely increase.

Methods for the chemical synthesis of isobutanol are known, such as oxo synthesis, catalytic hydrogenation of carbon monoxide (Ullmann's *Encyclopedia of Industrial Chemistry*, 6$^{th}$ edition, 2003, Wiley-VCHVerlag GmbH and Co., Weinheim, Germany, Vol. 5, pp. 716-719) and Guerbet condensation of methanol with n-propanol (Carlini et al., *J. Mol. Catal. A: Chem.* 220:215-220 (2004)). These processes use starting materials derived from petrochemicals and are generally expensive and are not environmentally friendly. The production of isobutanol from plant-derived raw materials would minimize green house gas emissions and would represent an advance in the art.

Isobutanol is produced biologically as a by-product of yeast fermentation. It is a component of "fusel oil" that forms as a result of incomplete metabolism of amino acids by this group of fungi. Isobutanol is specifically produced from catabolism of L-valine. After the amine group of L-valine is harvested as a nitrogen source, the resulting α-keto acid is decarboxylated and reduced to isobutanol by enzymes of the so-called Ehrlich pathway (Dickinson et al., *J. Biol. Chem.* 273(40):25752-25756 (1998)). Yields of fusel oil and/or its components achieved during beverage fermentation are typically low. For example, the concentration of isobutanol produced in beer fermentation is reported to be less than 16 parts per million (Garcia et al., *Process Biochemistry* 29:303-309 (1994)). Addition of exogenous L-valine to the fermentation increases the yield of isobutanol, as described by Dickinson et al., supra, wherein it is reported that a yield of isobutanol of 3 g/L is obtained by providing L-valine at a concentration of 20 g/L in the fermentation. However, the use of valine as a feed-stock would be cost prohibitive for industrial scale isobutanol production. The biosynthesis of isobutanol directly from sugars would be economically viable and would represent an advance in the art.

There is a need, therefore, for an environmentally responsible, cost-effective process for the production of isobutanol as a single product. The present invention addresses this need by providing a recombinant microbial production host that expresses an isobutanol biosynthetic pathway.

SUMMARY OF THE INVENTION

Provided herein are methods for producing isobutanol at industrial scale comprising;
 a. providing a carbon substrate;
 b. providing a recombinant microorganism having an engineered isobutanol biosynthetic pathway and a gene inactivation in a competing pathway for carbon flow wherein said pathway comprises the following substrate to product conversions;
  i. pyruvate to acetolactate (pathway step a)
  ii. acetolactate to 2,3-dihydroxyisovalerate (pathway step b)
  iii. 2,3-dihydroxyisovalerate to α-ketoisovalerate (pathway step c)
  iv. α-ketoisovalerate to isobutyraldehyde, (pathway step d),
  v. isobutyraldehyde to isobutanol; (pathway step e);
 c. contacting the recombinant microorganism with the carbon substrate whereby the microorganism produces isobutanol.

In embodiments, the gene inactivation comprises deletion of Idhl1. In embodiments, the gene inactivation comprises inactivation of pyruvate decarboxylase. In embodiments, the gene inactivation comprises deletion of PDC1, PDC5, or PDC6. In embodiments, the recombinant microorganism is *Saccharomyces, Candida, Pichia, Kluyveromyces, Yarrowia*, or *Schizosaccharomyces*. In embodiments, the engineered isobutanol pathway comprises at least one substrate to product conversion that utilizes NADH or NADPH as an electron donor. In embodiments, the methods further comprise isolating the isobutanol. In embodiments, isolating the isobutanol comprises liquid-liquid extraction with a suitable solvent.

Also provided herein are recombinant microbial host cells comprising heterologous DNA molecules encoding polypeptides that catalyze substrate to product conversions for each step below:
 i) pyruvate to acetolactate (pathway step a)
 ii) acetolactate to 2,3-dihydroxyisovalerate (pathway step b)
 iii) 2,3-dihydroxyisovalerate to α-ketoisovale rate (pathway step c)
 iv) α-ketoisovalerate to isobutyraldehyde, (pathway step d), and
wherein the host cells comprise a gene inactivation in a competing pathway for carbon flow and wherein said microbial host cell produces isobutanol; and wherein
 a) the polypeptide that catalyzes a substrate to product conversion of pyruvate to acetolactate is acetolactate synthase having the EC number 2.2.1.6;
 b) the polypeptide that catalyzes a substrate to product conversion of acetolactate to 2,3-dihydroxyisovalerate is acetohydroxy acid isomeroreductase having the EC number 1.1.1.86;
 c) the polypeptide that catalyzes a substrate to product conversion of 2,3-dihydroxyisovalerate to α-ketoisovalerate is acetohydroxy acid dehydratase having the EC number 4.2.1.9;

d) the polypeptide that catalyzes a substrate to product conversion of α-ketoisovalerate to isobutyraldehyde is branched-chain α-keto acid decarboxylase having the EC number 4.1.1.72.

In embodiments, the cell is selected from the group consisting of: a bacterium, a cyanobacterium, a filamentous fungus and a yeast. In embodiments, the cell is a member of a genus selected from the group consisting of *Clostridium, Zymomonas, Escherichia, Salmonella, Rhodococcus, Pseudomonas, Bacillus, Lactobacillus, Enterococcus, Alcaligenes, Klebsiella, Paenibacillus, Arthrobacter, Corynebacterium, Brevibacterium, Pichia, Candida, Hansenula, Kluyveromyces, Yarrowia, Schizosaccharomyces*, and *Saccharomyces*. In embodiments, the cell is *Escherichia coli, Lactobacillus plantarum*, or *Saccharomyces cerevisiae*. In embodiments, at least one polypeptide that catalyzes a substrate to product conversion utilizes NADH or NADPH as an electron donor. In embodiments, at least one DNA molecule encoding a polypeptide that catalyzes a substrate to product conversion comprises a new start codon to eliminate mitochondrial targeting. In embodiments, the acetolactate synthase has at least 90% identity to SEQ ID NO:2, SEQ ID NO:178, or SEQ ID NO:180. In embodiments, the acetolactate synthase is cytosol-localized. In embodiments, the acetohydroxy acid isomeroreductase has at least 90% identity to SEQ ID NO:43, SEQ ID NO:181, SEQ ID NO:183, or SEQ ID NO:185. In embodiments, the acetohydroxy acid isomeroreductase has at least 90% identity to SEQ ID NO: 268. In embodiments, the aceothydroxy acid isomeroreductase is SEQ ID NO: 269, 270, 271, 272, 273, 274, 275, 276, 277, or 278. In embodiments, the acetohydroxy acid isomeroreductase is SEQ ID NO: 279, 280, 281, 282, 283, 284, 285, 286, 287, 288, 289, 290, 291, 292, 293, 294, 295, 296, 297, 298, 299, 300, 301, or 302. In embodiments, the acetohydroxy acid isomeroreductase matches the KARI Profile HMM with an E value of <10$^{-3}$ using hmmsearch. In embodiments, the gene inactivation comprises inactivation of lactate dehydrogenase. In embodiments, the gene inactivation comprises deletion of ldhl1. In embodiments, the gene inactivation comprises inactivation of pyruvate decarboxylase. In embodiments, the gene inactivation comprises deletion of PDC1, PDC5, or PDC6. In embodiments, the host cell further comprises at least one heterologous DNA molecule encoding a polypeptide that catalyzes the substrate to product conversion isobutyraldehyde to isobutanol (pathway step e).

BRIEF DESCRIPTION OF THE FIGURES AND SEQUENCE DESCRIPTIONS

The invention can be more fully understood from the following detailed description, figure, and the accompanying sequence descriptions, which form a part of this application.

FIG. 1 shows four different isobutanol biosynthetic pathways. The steps labeled "a", "b", "c", "d", "e", "f", "g", "h", "i", "j" and "k" represent the substrate to product conversions described below.

Table A is a table of the KARI Profile HMM. Table A is submitted herewith electronically and is incorporated by reference.

The following sequences conform with 37 C.F.R. 1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (2009) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

TABLE 1

Summary of Gene and Protein SEQ ID Numbers

| Description | SEQ ID NO: Nucleic acid | SEQ ID NO: Peptide |
|---|---|---|
| *Klebsiella pneumoniae* budB (acetolactate synthase) | 1 | 2 |
| *Bacillus subtilis* alsS (acetolactate synthase) | 78 | 178 |
| *Lactococcus lactis* als (acetolactate synthase) | 179 | 180 |
| *E. coli* ilvC (acetohydroxy acid reductoisomerase) | 3 | 4 |
| *S. cerevisiae* ILV5 (acetohydroxy acid reductoisomerase) | 80 | 181 |
| *M. maripaludis* ilvC (Ketol-acid reductoisomerase) | 182 | 183 |
| *B. subtilis* ilvC (acetohydroxy acid reductoisomerase) | 184 | 185 |
| *Pseudomonas fluorescens* PF5 ilvC (ketol-acid reductoisomerase) | — | 268 |
| Mutant (Y24F/R47Y/S50A/T52D/V53A/L61F/G170A) of *Pseudomonas fluorescens* PF5 ilvC (ketol-acid reductoisomerase) | — | 269 |
| "ZB1" Mutant (Y24F/R47Y/S50A/T52D/V53A/L61F/A156V) of *Pseudomonas fluorescens* PF5 ilvC (ketol-acid reductoisomerase) | — | 270 |
| "ZF3" Mutant (Y24F/C33L/R47Y/S50A/T52D/V53A/L61F) of *Pseudomonas fluorescens* PF5 ilvC (ketol-acid reductoisomerase) | — | 271 |
| "ZF2" Mutant (Y24F/C33L/R47Y/S50A/T52D/V53A/L61F/A156V) of *Pseudomonas fluorescens* PF5 ilvC (ketol-acid reductoisomerase) | — | 272 |
| "ZB3" Mutant (Y24F/C33L/R47Y/S50A/T52D/V53A/L61F) of *Pseudomonas fluorescens* PF5 ilvC (ketol-acid reductoisomerase) | — | 273 |
| "Z4B8" Mutant (C33L/R47Y/S50A/T52D/V53A/L61F/T80I/A156V/G170A) of *Pseudomonas fluorescens* PF5 ilvC (ketol-acid reductoisomerase) | — | 274 |
| "3361G8" Mutant (C33L/R47Y/S50A/T52D/V53A/L61F/T80I) of *Pseudomonas fluorescens* PF5 ilvC (ketol-acid reductoisomerase) | — | 275 |
| "2H10" Mutant (Y24F/C33L/R47Y/S50A/T52D/V53I/L61F/T80I/A156V) of *Pseudomonas fluorescens* PF5 ilvC (ketol-acid reductoisomerase) | — | 276 |
| "1D2" Mutant (Y24F/R47Y/S50A/T52D/V53A/L61F/T80I/A156V) of *Pseudomonas fluorescens* PF5 ilvC (ketol-acid reductoisomerase) | — | 277 |
| "3F12" Mutant Y24F/C33L/R47Y/S50A/T52D/V53A/L61F/T80I/A156V) of *Pseudomonas fluorescens* PF5 ilvC (ketol-acid reductoisomerase) | — | 278 |

TABLE 1-continued

Summary of Gene and Protein SEQ ID Numbers

| Description | SEQ ID NO: Nucleic acid | SEQ ID NO: Peptide |
|---|---|---|
| "JB1C6" Mutant (Y24F/C33L/R47H/S50D/T52Y/V53Y/L61F/T80I/A156V) of *Pseudomonas fluorescens* PF5 ilvC (ketol-acid reductoisomerase) | — | 279 |
| "16445E4" Mutant (C33L/R47P/S50D/T52D/V53G/L61F/T80I/A156V) of *Pseudomonas fluorescens* PF5 ilvC (ketol-acid reductoisomerase) | — | 280 |
| "16468D7" Mutant (Y24F/C33L/R47T/S50I/T52D/V53R/L61F/T80I/A156V) of *Pseudomonas fluorescens* ilvC (ketol-acid reductoisomerase) | — | 281 |
| "16469F3" Mutant (C33L/R47E/S50A/T52D/V53A/L61F/T80I) of *Pseudomonas fluorescens* PF5 ilvC (ketol-acid reductoisomerase) | — | 282 |
| "JEA1" Mutant (Y24F/C33L/R47P/S50F/T52D/L61F/T80I/A156V) of *Pseudomonas fluorescens* PF5 ilvC (ketol-acid reductoisomerase) | — | 283 |
| "JEG2" Mutant (Y24F/C33L/R47F/S50A/T52D/V53A/L61F/T80I/A156V) of *Pseudomonas fluorescens* PF5 ilvC (ketol-acid reductoisomerase) | — | 284 |
| "JEG4" Mutant (Y24F/C33L/R47N/S50N/T52D/V53A/L61F/T80I/A156V) of *Pseudomonas fluorescens* PF5 ilvC (ketol-acid reductoisomerase) | — | 285 |
| "JEA7" Mutant (Y24F/C33L/R47P/S50N/T52D/V53A/L61F/T80I/A156V) of *Pseudomonas fluorescens* PF5 ilvC (ketol-acid reductoisomerase) | — | 286 |
| "JED1" Mutant (C33L/R47N/S50N/T52D/V53A/L61F/T80I/A156V) of *Pseudomonas fluorescens* PF5 ilvC (ketol-acid reductoisomerase) | — | 287 |
| "3361E1" Mutant of *Pseudomonas fluorescens* PF5 ilvC (ketol-acid reductoisomerase) | — | 288 |
| "C2F6" Mutant of *Pseudomonas fluorescens* PF5 ilvC (ketol-acid reductoisomerase) | — | 289 |
| "C3B11" Mutant of *Pseudomonas fluorescens* PF5 ilvC (ketol-acid reductoisomerase) | — | 290 |
| "C4D12" Mutant of *Pseudomonas fluorescens* PF5 ilvC (ketol-acid reductoisomerase) | — | 291 |
| "SE1" Mutant of *Pseudomonas fluorescens* PF5 ilvC (ketol-acid reductoisomerase) | — | 292 |
| "SE2" Mutant of *Pseudomonas fluorescens* PF5 ilvC (ketol-acid reductoisomerase) | — | 293 |
| "SB3" Mutant of *Pseudomonas fluorescens* PF5 ilvC (ketol-acid reductoisomerase) | — | 294 |
| "SD3" Mutant of *Pseudomonas fluorescens* PF5 ilvC (ketol-acid reductoisomerase) | — | 295 |
| "9650E5" Mutant of *Pseudomonas fluorescens* PF5 ilvC (ketol-acid reductoisomerase) | — | 296 |
| "9667A11" Mutant of *Pseudomonas fluorescens* PF5 ilvC (ketol-acid reductoisomerase) | — | 297 |
| "9862B9" Mutant of *Pseudomonas fluorescens* PF5 ilvC (ketol-acid reductoisomerase) | — | 298 |
| "9875B9" Mutant of *Pseudomonas fluorescens* PF5 ilvC (ketol-acid reductoisomerase) | — | 299 |
| "11461D8" Mutant of *Pseudomonas fluorescens* PF5 ilvC (ketol-acid reductoisomerase) | — | 300 |
| "11463" Mutant of *Pseudomonas fluorescens* PF5 ilvC (ketol-acid reductoisomerase) | — | 301 |
| "11518B4" Mutant of *Pseudomonas fluorescens* PF5 ilvC (ketol-acid reductoisomerase) | — | 302 |
| *E. coli* ilvD (acetohydroxy acid dehydratase) | 5 | 6 |
| *S. cerevisiae* ILV3 (Dihydroxyacid dehydratase) | 83 | 186 |
| *M. maripaludis* ilvD (Dihydroxy-acid dehydratase) | 187 | 188 |
| *B. subtilis* ilvD (dihydroxy-acid dehydratase) | 189 | 190 |
| *Lactococcus lactis* kivD (branched-chain α-keto acid decarboxylase), codon optimized | 7 | 8 |
| *Lactococcus lactis* kivD (branched-chain α-keto acid decarboxylase), | 191 | 8 |
| *Lactococcus lactis* kdcA (branched-chain alpha-ketoacid decarboxylase) | 192 | 193 |
| *Salmonella typhimurium* (indolepyruvate decarboxylase) | 194 | 195 |
| *Clostridium acetobutylicum* pdc (Pyruvate decarboxylase) | 196 | 197 |
| *E. coli* yqhD (branched-chain alcohol dehydrogenase) | 9 | 10 |
| *S. cerevisiae* YPR1 (2-methylbutyraldehyde reductase) | 198 | 199 |
| *S. cerevisiae* ADH6 (NADPH-dependent cinnamyl alcohol dehydrogenase) | 200 | 201 |
| *Clostridium acetobutylicum* bdhA (NADH-dependent butanol dehydrogenase A) | 202 | 203 |
| *Clostridium acetobutylicum* bdhB Butanol dehydrogenase | 158 | 204 |
| *B. subtilis* bkdAA (branched-chain keto acid dehydrogenase E1 subunit) | 205 | 206 |
| *B. subtilis* bkdAB (branched-chain alpha-keto acid dehydrogenase E1 subunit) | 207 | 208 |
| *B. subtilis* bkdB (branched-chain alpha-keto acid dehydrogenase E2 subunit) | 209 | 210 |
| *B. subtilis* lpdV (branched-chain alpha-keto acid dehydrogenase E3 subunit) | 211 | 212 |
| *P. putida* bkdA1 (keto acid dehydrogenase E1-alpha subunit) | 213 | 214 |
| *P. putida* bkdA2 (keto acid dehydrogenase E1-beta subunit) | 215 | 216 |
| *P. putida* bkdB (transacylase E2) | 217 | 218 |
| *P. putida* lpdV (lipoamide dehydrogenase) | 219 | 220 |

TABLE 1-continued

Summary of Gene and Protein SEQ ID Numbers

| Description | SEQ ID NO: Nucleic acid | SEQ ID NO: Peptide |
|---|---|---|
| *C. beijerinckii* ald (coenzyme A acylating aldehyde dehydrogenase) | 221 | 222 |
| *C. acetobutylicum* adhe1 (aldehyde dehydrogenase) | 223 | 224 |
| *C. acetobutylicum* adhe (alcohol-aldehyde dehydrogenase) | 225 | 226 |
| *P. putida* nahO (acetaldehyde dehydrogenase) | 227 | 228 |
| *T. thermophilus* (acetaldehyde dehydrogenase) | 229 | 230 |
| *E. coli* avtA (valine-pyruvate transaminase) | 231 | 232 |
| *B. licheniformis* avtA (valine-pyruvate transaminase) | 233 | 234 |
| *E. coli* ilvE (branched chain amino acid aminotransferase) | 235 | 236 |
| *S. cerevisiae* BAT2 (branched chain amino acid aminotransferase) | 237 | 238 |
| *M. thermoautotrophicum* (branched chain amino acid aminotransferase) | 239 | 240 |
| *S. coelicolor* (valine dehydrogenase) | 241 | 242 |
| *B.. subtilis* bcd (leucine dehydrogenase) | 243 | 244 |
| *S. viridifaciens* (valine decarboxyase) | 245 | 246 |
| *A. denitrificans* aptA (omega-amino acid: pyruvate transaminase) | 247 | 248 |
| *R. eutropha* (alanine-pyruvate transaminase) | 249 | 250 |
| *S. oneidensis* (beta alanine-pyruvate transaminase) | 251 | 252 |
| *P. putida* (beta alanine-pyruvate transaminase) | 253 | 254 |
| *S. cinnamonensis* icm (isobutyrl-CoA mutase) | 255 | 256 |
| *S. cinnamonensis* icmB (isobutyrl-CoA mutase) | 257 | 258 |
| *S. coelicolor* SCO5415 (isobutyrl-CoA mutase) | 259 | 260 |
| *S. coelicolor* SCO4800 (isobutyrl-CoA mutase) | 261 | 262 |
| *S. avermitilis* icmA (isobutyrl-CoA mutase) | 263 | 264 |
| *S. avermitilis* icmB (isobutyrl-CoA mutase) | 265 | 266 |

SEQ ID NOs:11-38, 40-69, 72-75, 85-138, 144, 145, 147-157, 159-176 are the nucleotide sequences of oligonucleotide cloning, screening or sequencing primers used in the Examples described herein.

SEQ ID NO:39 is the nucleotide sequence of the cscBKA gene cluster described in Example 16.

SEQ ID NO:70 is the nucleotide sequence of the glucose isomerase promoter 1.6GI described in Example 13.

SEQ ID NO:71 is the nucleotide sequence of the 1.5GI promoter described in Example 13.

SEQ ID NO:76 is the nucleotide sequence of the GPD promoter described in Example 17.

SEQ ID NO:77 is the nucleotide sequence of the CYC1 terminator described in Example 17.

SEQ ID NO:79 is the nucleotide sequence of the FBA promoter described in Example 17.

SEQ ID NO:81 is the nucleotide sequence of ADH1 promoter described in Example 17.

SEQ ID NO:82 is the nucleotide sequence of ADH1 terminator described in Example 17.

SEQ ID NO:84 is the nucleotide sequence of GPM promoter described in Example 17.

SEQ ID NO:139 is the amino acid sequence of sucrose hydrolase (CscA).

SEQ ID NO:140 is the amino acid sequence of D-fructokinase (CscK).

SEQ ID NO:141 is the amino acid sequence of sucrose permease (CscB).

SEQ ID NO:142 is the nucleotide sequence of plasmid pFP988DssPspac described in Example 20.

SEQ ID NO:143 is the nucleotide sequence of plasmid pFP988DssPgroE described in Example 20.

SEQ ID NO:146 is the nucleotide sequence of the pFP988Dss vector fragment described in Example 20.

SEQ ID NO:177 is the nucleotide sequence of the pFP988 integration vector described in Example 21.

SEQ ID NO:267 is the nucleotide sequence of plasmid pC194 described in Example 21.

DETAILED DESCRIPTION OF THE INVENTION

The present invention relates to methods for the production of isobutanol using recombinant microorganisms. The present invention meets a number of commercial and industrial needs. Butanol is an important industrial commodity chemical with a variety of applications, where its potential as a fuel or fuel additive is particularly significant. Although only a four-carbon alcohol, butanol has an energy content similar to that of gasoline and can be blended with any fossil fuel. Butanol is favored as a fuel or fuel additive as it yields only $CO_2$ and little or no $SO_X$ or $NO_X$ when burned in the standard internal combustion engine. Additionally butanol is less corrosive than ethanol, the most preferred fuel additive to date.

In addition to its utility as a biofuel or fuel additive, butanol has the potential of impacting hydrogen distribution problems in the emerging fuel cell industry. Fuel cells today are plagued by safety concerns associated with hydrogen transport and distribution. Butanol can be easily reformed for its hydrogen content and can be distributed through existing gas stations in the purity required for either fuel cells or vehicles.

Finally the present invention produces isobutanol from plant derived carbon sources, avoiding the negative environmental impact associated with standard petrochemical processes for butanol production.

The following definitions and abbreviations are to be used for the interpretation of the claims and the specification.

The term "invention" or "present invention" as used herein is a non-limiting term and is not intended to refer to any single embodiment of the particular invention but encompasses all possible embodiments as described in the specification and the claims.

The term "isobutanol biosynthetic pathway" refers to an enzyme pathway to produce isobutanol.

The terms "acetolactate synthase" and "acetolactate synthetase" are used interchangeably herein to refer to an enzyme that catalyzes the conversion of pyruvate to acetolactate and $CO_2$. Preferred acetolactate synthases are known by the EC number 2.2.1.6 (*Enzyme Nomenclature* 1992, Academic Press, San Diego). These enzymes are available from a number of sources, including, but not limited to, *Bacillus subtilis* (GenBank Nos: CAB15618 (SEQ ID NO:178), Z99122 (SEQ ID NO:78), NCBI (National Center for Biotechnology Information) amino acid sequence, NCBI nucleotide sequence, respectively), *Klebsiella pneumoniae* (GenBank Nos: AAA25079 (SEQ ID NO:2), M73842 (SEQ ID NO:1)), and *Lactococcus lactis* (GenBank Nos: AAA25161 (SEQ ID NO:180), L16975 (SEQ ID NO:179)).

The terms "acetohydroxy acid isomeroreductase" and "acetohydroxy acid reductoisomerase" and "ketol-acid reductoisomerase" (abbreviated "KARI") are used interchangeably herein and refer to an enzyme that catalyzes the conversion of acetolactate to 2,3-dihydroxyisovalerate. Suitable KARI enzymes are known by the EC number 1.1.1.86. KARI enzymes use electron donors such as NADPH and/or NADH for the conversion of acetolactate to 2,3-dihydroxyisovalerate. Sequences from a vast array of microorganisms are known in the art, including, but not limited to, *Escherichia coli* (GenBank Nos: NP_418222 (SEQ ID NO:4), NC_000913 (SEQ ID NO:3)), *Saccharomyces cerevisiae* (GenBank Nos: NP_013459 (SEQ ID NO:181), NC_001144 (SEQ ID NO:80)), *Methanococcus maripaludis* (GenBank Nos: CAF30210 (SEQ ID NO:183), BX957220 (SEQ ID NO:182)), *Bacillus. subtilis* (GenBank Nos: CAB14789 (SEQ ID NO:185), Z99118 (SEQ ID NO:184)), *Vibrio cholerae* (GenBank No. NC_00913), and *Psuedomonas aeruginosa* (GenBank No. NC_004129). Additional sequences are also described herein.

The term "acetohydroxy acid dehydratase" refers to an enzyme that catalyzes the conversion of 2,3-dihydroxyisovalerate to α-ketoisovalerate. Preferred acetohydroxy acid dehydratases are known by the EC number 4.2.1.9. These enzymes are available from a vast array of microorganisms, including, but not limited to, *E. coli* (GenBank Nos: YP_026248 (SEQ ID NO:6), NC_000913 (SEQ ID NO:5)), *S. cerevisiae* (GenBank Nos: NP_012550 (SEQ ID NO:186), NC_001142 (SEQ ID NO:83)), *M. maripaludis* (GenBank Nos: CAF29874 (SEQ ID NO:188), BX957219 (SEQ ID NO:187)), and *B. subtilis* (GenBank Nos: CAB14105 (SEQ ID NO:190), Z99115 (SEQ ID NO:189)).

The term "branched-chain α-keto acid decarboxylase" refers to an enzyme that catalyzes the conversion of α-ketoisovalerate to isobutyraldehyde and $CO_2$. Preferred branched-chain α-keto acid decarboxylases are known by the EC number 4.1.1.72 and are available from a number of sources, including, but not limited to, *Lactococcus lactis* (GenBank Nos: AAS49166 (SEQ ID NO:193), AY548760 (SEQ ID NO:192); CAG34226 (SEQ ID NO:8), AJ746364 (SEQ ID NO:191), *Salmonella typhimurium* (GenBank Nos: NP_461346 (SEQ ID NO:195), NC_003197 (SEQ ID NO:194)), and *Clostridium acetobutylicum* (GenBank Nos: NP_149189 (SEQ ID NO:197), NC_001988 (SEQ ID NO:196)). Alternatively, pyruvate decarboxylases of EC 4.1.1.-, eg, 4.1.1.1 may catalyze said reaction.

The term "branched-chain alcohol dehydrogenase" refers to an enzyme that catalyzes the conversion of isobutyraldehyde to isobutanol. Preferred branched-chain alcohol dehydrogenases are known by the EC number 1.1.1.265, but may also be classified under other alcohol dehydrogenases (specifically, EC 1.1.1.1 or 1.1.1.2). These enzymes utilize NADH (reduced nicotinamide adenine dinucleotide) and/or NADPH as electron donor and are available from a number of sources, including, but not limited to, *S. cerevisiae* (GenBank Nos: NP_010656 (SEQ ID NO:199), NC_001136 (SEQ ID NO:198); NP_014051 (SEQ ID NO:201) NC_001145 (SEQ ID NO:200)), *E. coli* (GenBank Nos: NP_417484 (SEQ ID NO:10), NC_000913 (SEQ ID NO:9)), and *C. acetobutylicum* (GenBank Nos: NP_349892 (SEQ ID NO:203), NC_003030 (SEQ ID NO:202); NP_349891 (SEQ ID NO:204), NC_003030 (SEQ ID NO:158)).

The term "branched-chain keto acid dehydrogenase" refers to an enzyme that catalyzes the conversion of α-ketoisovalerate to isobutyryl-CoA (isobutyryl-coenzyme A), using $NAD^+$ (nicotinamide adenine dinucleotide) as electron acceptor. Preferred branched-chain keto acid dehydrogenases are known by the EC number 1.2.4.4. These branched-chain keto acid dehydrogenases are comprised of four subunits and sequences from all subunits are available from a vast array of microorganisms, including, but not limited to, *B. subtilis* (GenBank Nos: CAB14336 (SEQ ID NO:206), Z99116 (SEQ ID NO:205); CAB14335 (SEQ ID NO:208), Z99116 (SEQ ID NO:207); CAB14334 (SEQ ID NO:210), Z99116 (SEQ ID NO:209); and CAB14337 (SEQ ID NO:212), Z99116 (SEQ ID NO:211)) and *Pseudomonas putida* (GenBank Nos: AAA65614 (SEQ ID NO:214), M57613 (SEQ ID NO:213); AAA65615 (SEQ ID NO:216), M57613 (SEQ ID NO:215); AAA65617 (SEQ ID NO:218), M57613 (SEQ ID NO:217); and AAA65618 (SEQ ID NO:220), M57613 (SEQ ID NO:219)).

The term "acylating aldehyde dehydrogenase" refers to an enzyme that catalyzes the conversion of isobutyryl-CoA to isobutyraldehyde, using either NADH or NADPH as electron donor. Preferred acylating aldehyde dehydrogenases are known by the EC numbers 1.2.1.10 and 1.2.1.57. These enzymes are available from multiple sources, including, but not limited to, *Clostridium beijerinckii* (GenBank Nos: AAD31841 (SEQ ID NO:222), AF157306 (SEQ ID NO:221)), *C. acetobutylicum* (GenBank Nos: NP_149325 (SEQ ID NO:224), NC_001988 (SEQ ID NO:223); NP_149199 (SEQ ID NO:226), NC_001988 (SEQ ID NO:225)), *P. putida* (GenBank Nos: AAA89106 (SEQ ID NO:228), U13232 (SEQ ID NO:227)), and *Thermus thermophilus* (GenBank Nos: YP_145486 (SEQ ID NO:230), NC_006461 (SEQ ID NO:229)).

The term "transaminase" refers to an enzyme that catalyzes the conversion of α-ketoisovalerate to L-valine, using either alanine or glutamate as amine donor. Preferred transaminases are known by the EC numbers 2.6.1.42 and 2.6.1.66. These enzymes are available from a number of sources. Examples of sources for alanine-dependent enzymes include, but are not limited to, *E. coli* (GenBank Nos: YP_026231 (SEQ ID NO:232), NC_000913 (SEQ ID NO:231)) and *Bacillus licheniformis* (GenBank Nos: YP_093743 (SEQ ID NO:234), NC_006322 (SEQ ID NO:233)). Examples of sources for glutamate-dependent enzymes include, but are not limited to, *E. coli* (GenBank Nos: YP_026247 (SEQ ID NO:236), NC_000913 (SEQ ID NO:235)), *S. cerevisiae* (GenBank Nos: NP_012682 (SEQ ID NO:238), NC_001142 (SEQ ID NO:237)) and *Methanobacterium thermoautotrophicum* (GenBank Nos: NP_276546 (SEQ ID NO:240), NC_000916 (SEQ ID NO:239)).

The term "valine dehydrogenase" refers to an enzyme that catalyzes the conversion of α-ketoisovalerate to L-valine, using NAD(P)H as electron donor and ammonia as amine donor. Preferred valine dehydrogenases are known by the EC numbers 1.4.1.8 and 1.4.1.9 and are available from a number of sources, including, but not limited to, *Streptomyces coelicolor* (GenBank Nos: NP_628270 (SEQ ID NO:242), NC_003888 (SEQ ID NO:241)) and *B. subtilis* (GenBank Nos: CAB14339 (SEQ ID NO:244), Z99116 (SEQ ID NO:243)).

The term "valine decarboxylase" refers to an enzyme that catalyzes the conversion of L-valine to isobutylamine and $CO_2$. Preferred valine decarboxylases are known by the EC number 4.1.1.14. These enzymes are found in Streptomycetes, such as for example, *Streptomyces viridifaciens* (GenBank Nos: AAN10242 (SEQ ID NO:246), AY116644 (SEQ ID NO:245)).

The term "omega transaminase" refers to an enzyme that catalyzes the conversion of isobutylamine to isobutyraldehyde using a suitable amino acid as amine donor. Preferred omega transaminases are known by the EC number 2.6.1.18 and are available from a number of sources, including, but not limited to, *Alcaligenes denitrificans* (AAP92672 (SEQ ID NO:248), AY330220 (SEQ ID NO:247)), *Ralstonia eutropha* (GenBank Nos: YP_294474 (SEQ ID NO:250), NC_007347 (SEQ ID NO:249)), *Shewanella oneidensis* (GenBank Nos: NP_719046 (SEQ ID NO:252), NC_004347 (SEQ ID NO:251)), and *P. putida* (GenBank Nos: AAN66223 (SEQ ID NO:254), AE016776 (SEQ ID NO:253)).

The term "isobutyryl-CoA mutase" refers to an enzyme that catalyzes the conversion of butyryl-CoA to isobutyryl-CoA. This enzyme uses coenzyme $B_{12}$ as cofactor. Preferred isobutyryl-CoA mutases are known by the EC number 5.4.99.13. These enzymes are found in a number of Streptomycetes, including, but not limited to, *Streptomyces cinnamonensis* (GenBank Nos: AAC08713 (SEQ ID NO:256), U67612 (SEQ ID NO:255); CAB59633 (SEQ ID NO:258), AJ246005 (SEQ ID NO:257)), *S. coelicolor* (GenBank Nos: CAB70645 (SEQ ID NO:260), AL939123 (SEQ ID NO:259); CAB92663 (SEQ ID NO:262), AL939121 (SEQ ID NO:261)), and *Streptomyces avermitilis* (GenBank Nos: NP_824008 (SEQ ID NO:264), NC_003155 (SEQ ID NO:263); NP_824637 (SEQ ID NO:266), NC_003155 (SEQ ID NO:265)).

The term "a facultative anaerobe" refers to a microorganism that can grow in both aerobic and anaerobic environments.

The term "carbon substrate" or "fermentable carbon substrate" refers to a carbon source capable of being metabolized by host organisms of the present invention and particularly carbon sources selected from the group consisting of monosaccharides, oligosaccharides, polysaccharides, and one-carbon substrates or mixtures thereof. Sources of carbon substrates include, but are limited to, plant-derived material, such as corn, sugar cane and lignocellulosic feedstocks.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

As used herein the term "coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing site, effector binding site and stem-loop structure.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "operably linked" refers to the association of nucleic acid sequences on a single nucleic acid fragment so that the function of one is affected by the other. For example, a promoter is operably linked with a coding sequence when it is capable of effecting the expression of that coding sequence (i.e., that the coding sequence is under the transcriptional control of the promoter). Coding sequences can be operably linked to regulatory sequences in sense or antisense orientation.

The term "expression", as used herein, refers to the transcription and stable accumulation of sense (mRNA) or antisense RNA derived from the nucleic acid fragment of the invention. Expression may also refer to translation of mRNA into a polypeptide.

As used herein the term "transformation" refers to the transfer of a nucleic acid fragment into a host organism, resulting in genetically stable inheritance. Host organisms containing the transformed nucleic acid fragments are referred to as "transgenic" or "recombinant" or "transformed" organisms.

The terms "plasmid", "vector" and "cassette" refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host.

As used herein, an "isolated nucleic acid fragment" or "isolated nucleic acid molecule" or "genetic construct" will be used interchangeably and will mean a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, $2^{nd}$ ed., Cold Spring Harbor Laboratory: Cold Spring Harbor, N.Y. (1989), particularly Chapter 11 and Table 11.1 therein (entirely incorporated herein by reference). The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular fungal proteins. The skilled artisan, having the benefit of the sequences as reported herein, may now use all or a substantial portion of the disclosed sequences for purposes known to those skilled in this art. Accordingly, the instant invention comprises the complete sequences as reported in the accompanying Sequence Listing, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The terms "homology" and "homologous" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that homologous nucleic acid sequences encompassed by this invention are also defined by their ability to hybridize, under moderately stringent conditions (e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) Sequence Analysis Primer (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (described by Higgins and Sharp, *CABIOS.* 5:151-153 (1989); Higgins, D. G. et al., *Comput. Appl. Biosci.,* 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191(1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, wherein such polypeptides have the same or similar function or activity. Useful examples of percent identities include, but are not limited to: 24%, 30%, 35%, 40%, 45%, 50%, 55%, 60%, 65%, 70%, 75%, 80%, 85%, 90%, or 95%, or any integer percentage from 24% to 100% may be useful in describing the present invention, such as 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.*, [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987).

Isobutanol Biosynthetic Pathways

Carbohydrate utilizing microorganisms employ the Embden-Meyerhof-Parnas (EMP) pathway, the Entner-Doudoroff pathway and the pentose phosphate cycle as the central, metabolic routes to provide energy and cellular precursors for growth and maintenance. These pathways have in common the intermediate glyceraldehyde-3-phosphate and, ultimately, pyruvate is formed directly or in combination with the EMP pathway. Subsequently, pyruvate is transformed to acetyl-coenzyme A (acetyl-CoA) via a variety of means. Acetyl-CoA serves as a key intermediate, for example, in generating fatty acids, amino acids and secondary metabolites. The combined reactions of sugar conversion to pyruvate produce energy (e.g. adenosine-5'-triphosphate, ATP) and reducing equivalents (e.g. reduced nicotinamide adenine dinucleotide, NADH, and reduced nicotinamide adenine dinucleotide phosphate, NADPH). NADH and NADPH must be recycled to their oxidized forms ($NAD^+$ and $NADP^+$, respectively). In the presence of inorganic electron acceptors (e.g. $O_2$, $NO_3^-$ and $SO_4^{2-}$), the reducing equivalents may be used to augment the energy pool; alternatively, a reduced carbon by-product may be formed.

The invention enables the production of isobutanol from carbohydrate sources with recombinant microorganisms by providing four complete reaction pathways, as shown in FIG. 1. Three of the pathways comprise conversion of pyruvate to isobutanol via a series of enzymatic steps. The preferred isobutanol pathway (FIG. 1, steps a to e), comprises the following substrate to product conversions:
- a) pyruvate to acetolactate, as catalyzed for example by acetolactate synthase,
- b) acetolactate to 2,3-dihydroxyisovalerate, as catalyzed for example by acetohydroxy acid isomeroreductase,
- c) 2,3-dihydroxyisovalerate to α-ketoisovalerate, as catalyzed for example by acetohydroxy acid dehydratase,
- d) α-ketoisovalerate to isobutyraldehyde, as catalyzed for example by a branched-chain keto acid decarboxylase, and
- e) isobutyraldehyde to isobutanol, as catalyzed for example by, a branched-chain alcohol dehydrogenase.

This pathway combines enzymes known to be involved in well-characterized pathways for valine biosynthesis (pyruvate to α-ketoisovalerate) and valine catabolism (α-ketoisovalerate to isobutanol). Since many valine biosynthetic enzymes also catalyze analogous reactions in the isoleucine biosynthetic pathway, substrate specificity is a major consideration in selecting the gene sources. For this reason, the primary genes of interest for the acetolactate synthase enzyme are those from *Bacillus* (alsS) and *Klebsiella* (budB). These particular acetolactate synthases are known to participate in butanediol fermentation in these organisms and show increased affinity for pyruvate over ketobutyrate (Gollop et al., *J. Bacteriol.* 172(6):3444-3449 (1990); Holtzclaw et al., *J. Bacteriol.* 121(3):917-922 (1975)).

The second and third pathway steps are catalyzed by acetohydroxy acid reductoisomerase and dehydratase, respectively. These enzymes have been characterized from a number of sources, such as for example, *E. coli* (Chunduru et al., *Biochemistry* 28(2):486-493 (1989); Flint et al., *J. Biol. Chem.* 268(29):14732-14742 (1993)). Further, bacterial dihydroxy-acid dehydratases having a [2 Fe-2S] cluster are described in US Application Publication No. 20100081154, incorporated herein by reference. The crystal structure of the *E. coli* KARI enzyme at 2.6 Å resolution has been solved (Tyagi, et al., Protein Sci., 14: 3089-3100, 2005). This enzyme consists of two domains, one with mixed α/β structure which is similar to that found in other pyridine nucleotide-dependent dehydrogenases. The second domain is mainly α-helical and shows strong evidence of internal duplication. Comparison of the active sites of KARI of *E. coli, Pseudomonas aeruginosa*, and spinach showed that most residues in the active site of the enzyme occupy conserved positions. While the *E. coli* KARI was crystallized as a tetramer, which is probably the likely biologically active unit, the *P. aeruginosa* KARI (Ahn, et al., J. Mol. Biol., 328: 505-515, 2003) formed a dodecamer, and the enzyme from spinach formed a dimer. Typically KARIs are slow enzymes with a reported turnover number ($k_{cat}$) of 2 s$^{-1}$ (Aulabaugh et al.; Biochemistry, 29: 2824-2830, 1990) or 0.12 s$^{-1}$ (Rane et al., Arch. Biochem. Biophys. 338: 83-89, 1997) for acetolactate. Studies have shown that genetic control of isoleucine-valine biosynthesis in *E. coli* is different than that in *Ps. aeruginosa* (Marinus, et al., Genetics, 63: 547-56, 1969).

A KARI Profile HMM generated from the alignment of the twenty-five KARIs with experimentally verified function is given in Table A. Suitable KARI enzymes include proteins that match the KARI Profile HMM with an E value of <10$^{-3}$ using hmmsearch program in the HMMER package. The theory behind profile HMMs is described in R. Durbin, S. Eddy, A. Krogh, and G. Mitchison, Biological sequence analysis: probabilistic models of proteins and nucleic acids, Cambridge University Press, 1998; Krogh et al., J. Mol. Biol. 235: 1501-1531, 1994. Further, KARI enzymes that are a member of a clade identified through molecular phylogenetic analysis called the SLSL clade are described in U.S. patent application Ser. No. 12/893,077, filed on Sep. 29, 2010, incorporated herein by reference. Additional suitable KARI enzymes are described in US Published Patent Application Nos. 20080261230, 20090163376, and 20100197519, each incorporated herein by reference.

The final two steps of the preferred isobutanol pathway are known to occur in yeast, which can use valine as a nitrogen source and, in the process, secrete isobutanol. α-Ketoisovalerate can be converted to isobutyraldehyde by a number of keto acid decarboxylase enzymes, such as for example pyruvate decarboxylase. To prevent misdirection of pyruvate away from isobutanol production, a decarboxylase with decreased affinity for pyruvate is desired. So far, there are two such enzymes known in the art (Smit et al., *Appl. Environ. Microbiol.* 71(1):303-311 (2005); de la Plaza et al., *FEMS Microbiol. Lett.* 238(2):367-374 (2004)). Both enzymes are from strains of *Lactococcus lactis* and have a 50-200-fold preference for ketoisovalerate over pyruvate. Finally, a number of aldehyde reductases have been identified in yeast, many with overlapping substrate specificity. Those known to prefer branched-chain substrates over acetaldehyde include, but are not limited to, alcohol dehydrogenase VI (ADH6) and Ypr1p (Larroy et al., *Biochem. J.* 361(Pt 1):163-172 (2002); Ford et al., *Yeast* 19(12):1087-1096 (2002)), both of which use NADPH as electron donor. An NADPH-dependent reductase, YqhD, active with branched-chain substrates has also been recently identified in *E. coli* (Sulzenbacher et al., *J. Mol. Biol.* 342(2):489-502 (2004)). An enzyme with butanol dehydrogenase activity, sadB, is described in US Application Publication No. 20090269823, incorporated herein by reference. Additional suitable alcohol dehydrogenase enzymes are described in U.S. Patent Application 61/290,636, filed on Dec. 29, 2009, incorporated herein by reference.

Another pathway for converting pyruvate to isobutanol comprises the following substrate to product conversions (FIG. 1, steps a,b,c,f,g,e):
- a) pyruvate to acetolactate, as catalyzed for example by acetolactate synthase,
- b) acetolactate to 2,3-dihydroxyisovalerate, as catalyzed for example by acetohydroxy acid isomeroreductase,
- c) 2,3-dihydroxyisovalerate to α-ketoisovalerate, as catalyzed for example by acetohydroxy acid dehydratase,
- f) α-ketoisovalerate to isobutyryl-CoA, as catalyzed for example by a branched-chain keto acid dehydrogenase,
- g) isobutyryl-CoA to isobutyraldehyde, as catalyzed for example by an acylating aldehyde dehydrogenase, and
- e) isobutyraldehyde to isobutanol, as catalyzed for example by, a branched-chain alcohol dehydrogenase.

The first three steps in this pathway (a,b,c) are the same as those described above. The α-ketoisovalerate is converted to isobutyryl-CoA by the action of a branched-chain keto acid dehydrogenase. While yeast can only use valine as a nitrogen source, many other organisms (both eukaryotes and prokaryotes) can use valine as the carbon source as well. These organisms have branched-chain keto acid dehydrogenase (Sokatch et al. *J. Bacteriol.* 148(2):647-652 (1981)), which generates isobutyryl-CoA. Isobutyryl-CoA may be converted to isobutyraldehyde by an acylating aldehyde dehydrogenase. Dehydrogenases active with the branched-chain substrate have been described, but not cloned, in *Leuconostoc* and *Propionibacterium* (Kazahaya et al., *J. Gen. Appl. Microbiol.* 18:43-55 (1972); Hosoi et al., *J. Ferment. Technol.* 57:418-427 (1979)). However, it is also possible that acylating aldehyde dehydrogenases known to function with straight-chain acyl-CoAs (i.e. butyryl-CoA), may also work with isobutyryl-CoA. The isobutyraldehyde is then converted to isobutanol by a branched-chain alcohol dehydrogenase, as described above for the first pathway.

Another pathway for converting pyruvate to isobutanol comprises the following substrate to product conversions (FIG. 1, steps a,b,c,h,i,j,e):
 a) pyruvate to acetolactate, as catalyzed for example by acetolactate synthase,
 b) acetolactate to 2,3-dihydroxyisovalerate, as catalyzed for example by acetohydroxy acid isomeroreductase,
 c) 2,3-dihydroxyisovalerate to α-ketoisovalerate, as catalyzed for example by acetohydroxy acid dehydratase,
 h) α-ketoisovalerate to valine, as catalyzed for example by valine dehydrogenase or transaminase,
 i) valine to isobutylamine, as catalyzed for example by valine decarboxylase,
 j) isobutylamine to isobutyraldehyde, as catalyzed for example by omega transaminase, and
 e) isobutyraldehyde to isobutanol, as catalyzed for example by, a branched-chain alcohol dehydrogenase.

The first three steps in this pathway (a,b,c) are the same as those described above. This pathway requires the addition of a valine dehydrogenase or a suitable transaminase. Valine (and or leucine) dehydrogenase catalyzes reductive amination and uses ammonia; $K_m$ values for ammonia are in the millimolar range (Priestly et al., Biochem J. 261(3):853-861 (1989); Vancura et al., J. Gen. Microbiol. 134(12):3213-3219 (1988) Zink et al., Arch. Biochem. Biophys. 99:72-77 (1962); Sekimoto et al. J. Biochem (Japan) 116(1):176-182 (1994)). Transaminases typically use either glutamate or alanine as amino donors and have been characterized from a number of organisms (Lee-Peng et al., J. Bacteriol. 139(2):339-345 (1979); Berg et al., J. Bacteriol. 155(3):1009-1014 (1983)). An alanine-specific enzyme may be desirable, since the generation of pyruvate from this step could be coupled to the consumption of pyruvate later in the pathway when the amine group is removed (see below). The next step is decarboxylation of valine, a reaction that occurs in valanimycin biosynthesis in Streptomyces (Garg et al., Mol. Microbiol. 46(2): 505-517 (2002)). The resulting isobutylamine may be converted to isobutyraldehyde in a pyridoxal 5'-phosphate-dependent reaction by, for example, an enzyme of the omega-aminotransferase family. Such an enzyme from Vibrio fluvialis has demonstrated activity with isobutylamine (Shin et al., Biotechnol. Bioeng. 65(2):206-211 (1999)). Another omega-aminotransferase from Alcaligenes denitrificans has been cloned and has some activity with butylamine (Yun et al., Appl. Environ. Microbiol. 70(4):2529-2534 (2004)). In this direction, these enzymes use pyruvate as the amino acceptor, yielding alanine. As mentioned above, adverse affects on the pyruvate pool may be offset by using a pyruvate-producing transaminase earlier in the pathway. The isobutyraldehyde is then converted to isobutanol by a branched-chain alcohol dehydrogenase, as described above for the first pathway.

The fourth isobutanol biosynthetic pathway comprises the substrate to product conversions shown as steps k,g,e in FIG. 1. A number of organisms are known to produce butyrate and/or butanol via a butyryl-CoA intermediate (Dürre et al., FEMS Microbiol. Rev. 17(3):251-262 (1995); Abbad-Andaloussi et al., Microbiology 142(5):1149-1158 (1996)). Isobutanol production may be engineered in these organisms by addition of a mutase able to convert butyryl-CoA to isobutyryl-CoA (FIG. 1, step k). Genes for both subunits of isobutyryl-CoA mutase, a coenzyme $B_{12}$-dependent enzyme, have been cloned from a Streptomycete (Ratnatilleke et al., J. Biol. Chem. 274(44):31679-31685 (1999)). The isobutyryl-CoA is converted to isobutyraldehyde (step g in FIG. 1), which is converted to isobutanol (step e in FIG. 1).

Thus, in providing multiple recombinant pathways from pyruvate to isobutanol, there exist a number of choices to fulfill the individual conversion steps, and the person of skill in the art will be able to utilize publicly available sequences to construct the relevant pathways. A listing of a representative number of genes known in the art and useful in the construction of isobutanol biosynthetic pathways are listed below in Table 2.

TABLE 2

Sources of Isobutanol Biosynthetic Pathway Genes

| Gene | GenBank Citation |
|---|---|
| acetolactate synthase | Z99122, Bacillus subtilis complete genome (section 19 of 21): from 3608981 to 3809670<br>gi\|32468830\|emb\|Z99122.2\|BSUB0019[32468830]<br>M73842, Klebsiella pneumoniae acetolactate synthase (iluk) gene, complete cds<br>gi\|149210\|gb\|M73842.1\|KPNILUK[149210]<br>L16975, Lactococcus lactis alpha-acetolactate synthase (als) gene, complete cds<br>gi\|473900\|gb\|L16975.1\|LACALS[473900] |
| acetohydroxy acid isomeroreductase | NC_000913, Escherichia coli K12, complete genome<br>gi\|49175990\|ref\|NC_000913.2\|[49175990]<br>NC_001144, Saccharomyces cerevisiae chromosome XII, complete chromosome sequence<br>gi\|42742286\|ref\|NC_001144.3\|[42742286]<br>BX957220, Methanococcus maripaludis S2 complete genome; segment 2/5<br>gi\|44920669\|emb\|BX957220.1\|[44920669]<br>Z99118, Bacillus subtilis complete genome (section 15 of 21): from 2812801 to 3013507<br>gi\|32468802\|emb\|Z99118.2\|BSUB0015[32468802] |
| acetohydroxy acid dehydratase | NC_000913, Escherichia coli K12, complete genome<br>gi\|49175990\|ref\|NC_000913.2\|[49175990]<br>NC_001142, Saccharomyces cerevisiae chromosome X, complete chromosome sequence<br>gi\|42742252\|ref\|NC_001142.5\|[42742252]<br>BX957219, Methanococcus maripaludis S2 complete genome; segment 1/5<br>gi\|45047123\|emb\|BX957219.1\|[45047123]<br>Z99115, Bacillus subtilis complete genome (section 12 of 21): from 2207806 to 2409180<br>gi\|32468778\|emb\|Z99115.2\|BSUB0012[32468778] |
| branched-chain α-keto acid decarboxylase | AY548760, Lactococcus lactis branched-chain alpha-ketoacid decarboxylase (kdcA) gene, complete cds<br>gi\|44921616\|gb\|AY548760.1\|[44921616]<br>AJ746364, Lactococcus lactis subsp. lactis kivd gene for alpha-ketoisovalerate decarboxylase, strain IFPL730<br>gi\|51870501\|emb\|AJ746364.1\|[51870501]<br>NC_003197, Salmonella typhimurium LT2, complete genome<br>gi\|16763390\|ref\|NC_003197.1\|[16763390]<br>NC_001988, Clostridium acetobutylicum ATCC 824 plasmid pSOL1, complete sequence<br>gi\|15004705\|ref\|NC_001988.2\|[15004705] |
| branched-chain alcohol dehydrogenase | NC_001136, Saccharomyces cerevisiae chromosome IV, complete chromosome sequence<br>gi\|50593138\|ref\|NC_001136.6\|[50593138]<br>NC_001145, Saccharomyces cerevisiae chromosome XIII, complete chromosome sequence<br>gi\|44829554\|ref\|NC_001145.2\|[44829554]<br>NC_000913, Escherichia coli K12, complete genome<br>gi\|49175990\|ref\|NC_000913.2\|[49175990]<br>NC_003030, Clostridium acetobutylicum ATCC 824, complete genome<br>gi\|15893298\|ref\|NC_003030.1\|[15893298] |

TABLE 2-continued

Sources of Isobutanol Biosynthetic Pathway Genes

| Gene | GenBank Citation |
|---|---|
| branched-chain keto acid dehydrogenase | Z99116, Bacillus subtilis complete genome (section 13 of 21): from 2409151 to 2613687<br>gi\|32468787\|emb\|Z99116.2\|BSUB0013[32468787]<br>M57613, Pseudomonas putida branched-chain keto acid dehydrogenase operon (bkdA1, bkdA1 and bkdA2), transacylase E2 (bkdB), bkdR and lipoamide dehydrogenase (lpdV) genes, complete cds<br>gi\|790512\|gb\|M57613.1\|PSEBKDPPG2[790512] |
| acylating aldehyde dehydrogenase | AF157306, Clostridium beijerinckii strain NRRL B593 hypothetical protein, coenzyme A acylating aldehyde dehydrogenase (ald), acetoacetate:butyrate/acetate coenzyme A transferase (ctfA), acetoacetate:butyrate/acetate coenzyme A transferase (ctfB), and acetoacetate decarboxylase (adc) genes, complete cds<br>gi\|47422980\|gb\|AF157306.2\|[47422980]<br>NC_001988, Clostridium acetobutylicum ATCC 824 plasmid pSOL1, complete sequence<br>gi\|15004705\|ref\|NC_001988.2\|[15004705]<br>U13232, Pseudomonas putida NCIB9816 acetaldehyde dehydrogenase (nahO) and 4-hydroxy-2-oxovalerate aldolase (nahM) genes, complete cds, and 4-oxalocrotonate decarboxylase (nahK) and 2-oxopent-4-enoate hydratase (nahL) genes, partial cds<br>gi\|595671\|gb\|U13232.1\|PPU13232[595671] |
| transaminase | NC_000913, Escherichia coli K12, complete genome<br>gi\|49175990\|ref\|NC_000913.2\|[49175990]<br>NC_006322, Bacillus licheniformis ATCC 14580, complete genome<br>gi\|52783855\|ref\|NC_006322.1\|[52783855]<br>NC_001142, Saccharomyces cerevisiae chromosome X, complete chromosome sequence<br>gi\|42742252\|ref\|NC_001142.5\|[42742252]<br>NC_000916, Methanothermobacter thermautotrophicus str. Delta H, complete genome<br>gi\|15678031\|ref\|NC_000916.1\|[15678031] |
| valine dehydrogenase | NC_003888, Streptomyces coelicolor A3(2), complete genome<br>gi\|32141095\|ref\|NC_003888.3\|[32141095]<br>Z99116, Bacillus subtilis complete genome (section 13 of 21): from 2409151 to 2613687<br>gi\|32468787\|emb\|Z99116.2\|BSUB0013[32468787] |
| valine decarboxylase | AY116644, Streptomyces viridifaciens amino acid aminotransferase gene, partial cds; ketol-acid reductoisomerase, acetolactate synthetase small subunit, acetolactate synthetase large subunit, complete cds; azoxy antibiotic valanimycin gene cluster, complete sequence; and putative transferase, and putative secreted protein genes, complete cds<br>gi\|27777548\|gb\|AY116644.1\|[27777548] |
| omega transaminase | AY330220, Achromobacter denitrificans omega-amino acid:pyruvate transaminase (aptA) gene, complete cds<br>gi\|33086797\|gb\|AY330220.1\|[33086797]<br>NC_007347, Ralstonia eutropha JMP134 chromosome 1, complete sequence<br>gi\|73539706\|ref\|NC_007347.1\|[73539706]<br>NC_004347, Shewanella oneidensis MR-1, complete genome<br>gi\|24371600\|ref\|NC_004347.1\|[24371600]<br>NZ_AAAG02000002, Rhodospirillum rubrum Rrub02_2, whole genome shotgun sequence<br>gi\|48764549\|ref\|NZ_AAAG02000002.1\|[48764549]<br>AE016776, Pseudomonas putida KT2440 section 3 of 21 of the complete genome<br>gi\|26557019\|gb\|AE016776.1\|[26557019] |
| isobutyryl-CoA mutase | U67612, Streptomyces cinnamonensis coenzyme B12-dependent isobutyrylCoA mutase (icm) gene, complete cds<br>gi\|3002491\|gb\|U67612.1\|SCU67612[3002491]<br>AJ246005, Streptomyces cinnamonensis icmB gene for isobutyryl-CoA mutase, small subunit<br>gi\|6137076\|emb\|AJ246005.1\|SCI246005[6137076]<br>AL939123, Streptomyces coelicolor A3(2) complete genome; segment 20/29 |

TABLE 2-continued

Sources of Isobutanol Biosynthetic Pathway Genes

| Gene | GenBank Citation |
|---|---|
| | gi\|24430032\|emb\|AL939123.1\|SCO939123[24430032]<br>AL9939121, Streptomyces coelicolor A3(2) complete genome; segment 18/29<br>gi\|24429533\|emb\|AL939121.1\|SCO939121[24429533]<br>NC_003155, Streptomyces avermitilis MA-4680, complete genome<br>gi\|57833846\|ref\|NC_003155.3\|[57833846] |

Microbial Hosts for Isobutanol Production

Microbial hosts for isobutanol production may be selected from bacteria, cyanobacteria, filamentous fungi and yeasts. The microbial host used for isobutanol production is preferably tolerant to isobutanol so that the yield is not limited by butanol toxicity. Microbes that are metabolically active at high titer levels of isobutanol are not well known in the art. Although butanol-tolerant mutants have been isolated from solventogenic Clostridia, little information is available concerning the butanol tolerance of other potentially useful bacterial strains. Most of the studies on the comparison of alcohol tolerance in bacteria suggest that butanol is more toxic than ethanol (de Cavalho et al., Microsc. Res. Tech. 64:215-22 (2004) and Kabelitz et al., FEMS Microbiol. Lett. 220:223-227 (2003)). Tomas et al. (J. Bacteriol. 186:2006-2018 (2004)) report that the yield of 1-butanol during fermentation in Clostridium acetobutylicum may be limited by 1-butanol toxicity. The primary effect of 1-butanol on Clostridium acetobutylicum is disruption of membrane functions (Hermann et al., Appl. Environ. Microbiol. 50:1238-1243 (1985)).

The microbial hosts selected for the production of isobutanol are preferably tolerant to isobutanol and should be able to convert carbohydrates to isobutanol. The criteria for selection of suitable microbial hosts include the following: intrinsic tolerance to isobutanol, high rate of glucose utilization, availability of genetic tools for gene manipulation, and the ability to generate stable chromosomal alterations.

Suitable host strains with a tolerance for isobutanol may be identified by screening based on the intrinsic tolerance of the strain. The intrinsic tolerance of microbes to isobutanol may be measured by determining the concentration of isobutanol that is responsible for 50% inhibition of the growth rate (IC50) when grown in a minimal medium. The IC50 values may be determined using methods known in the art. For example, the microbes of interest may be grown in the presence of various amounts of isobutanol and the growth rate monitored by measuring the optical density at 600 nanometers. The doubling time may be calculated from the logarithmic part of the growth curve and used as a measure of the growth rate. The concentration of isobutanol that produces 50% inhibition of growth may be determined from a graph of the percent inhibition of growth versus the isobutanol concentration. Preferably, the host strain should have an 1050 for isobutanol of greater than about 0.5%.

The microbial host for isobutanol production should also utilize glucose at a high rate. Most microbes are capable of utilizing carbohydrates. However, certain environmental microbes cannot utilize carbohydrates to high efficiency, and therefore would not be suitable hosts.

The ability to genetically modify the host is essential for the production of any recombinant microorganism. The mode of gene transfer technology may be by electroporation, conjugation, transduction or natural transformation. A broad range of host conjugative plasmids and drug resistance markers are available. The cloning vectors are tailored to the host organisms based on the nature of antibiotic resistance markers that can function in that host.

The microbial host also has to be manipulated in order to inactivate competing pathways for carbon flow by deleting various genes. This requires the availability of either transposons to direct inactivation or chromosomal integration vectors.

Many methods for genetic modification of target genes are known to one skilled in the art and may be used to create suitable strains. Genes encoding pyruvate decarboxylase may be disrupted in any yeast cell using genetic modification. Modifications that may be used to eliminate expression of a pyruvate decarboxylase target protein are disruptions that include, but are not limited to, deletion of the entire gene or a portion of the gene encoding a pyruvate decarboxylase, inserting a DNA fragment into a pyruvate decarboxylase encoding gene (in either the promoter or coding region) so that the protein is not expressed, introducing a mutation into a pyruvate decarboxylase coding region which adds a stop codon or frame shift such that a functional protein is not expressed, and introducing one or more mutations into a pyruvate decarboxylase coding region to alter amino acids so that a non-functional protein is expressed. In addition, expression of a pyruvate decarboxylase gene may be blocked by expression of an antisense RNA or an interfering RNA, and constructs may be introduced that result in cosuppression. In addition, the synthesis or stability of the transcript may be lessened by mutation. Similarly the efficiency by which a protein is translated from mRNA may be modulated by mutation. All of these methods may be readily practiced by one skilled in the art making use of the known or identified sequences encoding pyruvate decarboxylase proteins. Examples of yeast pyruvate decarboxylases that may be targeted for disruption include SEQ ID NOs: 304, 306, 308, 310, 312, 314, 316, 318, and 320.

Yeasts may have one or more genes encoding pyruvate decarboxylase. For example, there is one gene encoding pyruvate decarboxylase in *Kluyveromyces lactis*, while there are three isozymes of pyruvate decarboxylase encoded by the PDC1, PDC5, and PDC6 genes in *Saccharomyces cerevisiae*, as well as a pyruvate decarboxylase regulatory gene PDC2. Expression of pyruvate decarboxylase from PDC6 is minimal.

DNA sequences surrounding a pyruvate decarboxylase coding sequence are also useful in some modification procedures and are available for yeasts such as for *Saccharomyces cerevisiae* in the complete genome sequence coordinated by Genome Project ID9518 of Genome Projects coordinated by NCBI (National Center for Biotechnology Information) with identifying GOPID #13838. Additional examples of yeast genomic sequences include that of *Yarrowia lipolytica*, GOPIC #13837, and of *Candida albicans*, which is included in GPID #10771, #10701 and #16373. Other yeast genomic sequences can be readily found by one of skill in the art in publicly available databases.

In particular, DNA sequences surrounding a pyruvate decarboxylase coding sequence are useful for modification methods using homologous recombination. For example, in this method pyruvate decarboxylase gene flanking sequences are placed bounding a selectable marker gene to mediate homologous recombination whereby the marker gene replaces the pyruvate decarboxylase gene. Also partial pyruvate decarboxylase gene sequences and pyruvate decarboxylase gene flanking sequences bounding a selectable marker gene may be used to mediate homologous recombination whereby the marker gene replaces a portion of the target pyruvate decarboxylase gene. In addition, the selectable marker may be bounded by site-specific recombination sites, so that following expression of the corresponding site-specific recombinase, the resistance gene is excised from the pyruvate decarboxylase gene without reactivating the latter. The site-specific recombination leaves behind a recombination site which disrupts expression of the pyruvate decarboxylase protein. The homologous recombination vector may be constructed to also leave a deletion in the pyruvate decarboxylase gene following excision of the selectable marker, as is well known to one skilled in the art.

Deletions may be made using mitotic recombination as described in Wach et al. ((1994) Yeast 10:1793-1808). This method involves preparing a DNA fragment that contains a selectable marker between genomic regions that may be as short as 20 bp, and which bound a target DNA sequence. This DNA fragment can be prepared by PCR amplification of the selectable marker gene using as primers oligonucleotides that hybridize to the ends of the marker gene and that include the genomic regions that can recombine with the yeast genome. The linear DNA fragment can be efficiently transformed into yeast and recombined into the genome resulting in gene replacement including with deletion of the target DNA sequence (as described in Methods in Enzymology, v 194, pp 281-301 (1991)).

Additionally, the production host should be amenable to chemical mutagenesis so that mutations to improve intrinsic isobutanol tolerance may be obtained.

Based on the criteria described above, suitable microbial hosts for the production of isobutanol include, but are not limited to, members of the genera *Clostridium*, *Zymomonas*, *Escherichia*, *Salmonella*, *Rhodococcus*, *Pseudomonas*, *Bacillus*, *Lactobacillus*, *Enterococcus*, *Alcaligenes*, *Klebsiella*, *Paenibacillus*, *Arthrobacter*, *Corynebacterium*, *Brevibacterium*, *Pichia*, *Candida*, *Hansenula* and *Saccharomyces*. Preferred hosts include: *Escherichia coli*, *Alcaligenes eutrophus*, *Bacillus licheniformis*, *Paenibacillus macerans*, *Rhodococcus erythropolis*, *Pseudomonas putida*, *Lactobacillus plantarum*, *Enterococcus faecium*, *Enterococcus gallinarium*, *Enterococcus faecalis*, *Bacillus subtilis* and *Saccharomyces cerevisiae*.

Additional modifications that may be useful in cells provided herein include modifications to reduce glycerol-3-phosphate dehydrogenase activity as described in US Patent Application Publication No. 20090305363 (incorporated herein by reference), modifications to a host cell that provide for increased carbon flux through an Entner-Doudoroff Pathway or reducing equivalents balance as described in US Patent Application Publication No. 20100120105 (incorporated herein by reference). Yeast strains with increased activity of heterologous proteins that require binding of an Fe—S cluster for their activity are described in US Application Publication No. 20100081179 (incorporated herein by reference). Other modifications include modifications in an endogenous polynucleotide encoding a polypeptide having dual-role hexokinase activity, described in U.S. Provisional Application No. 61/290,639, integration of at least one polynucleotide encoding a polypeptide that catalyzes a step in a pyruvate-utilizing biosynthetic pathway described in U.S. Provisional Application No. 61/380,563 (both referenced provisional applications are incorporated herein by reference).

Additionally, host cells comprising at least one deletion, mutation, and/or substitution in an endogenous gene encoding a polypeptide affecting Fe—S cluster biosynthesis are described in U.S. Provisional Patent Application No. 61/305, 333 (incorporated herein by reference), and host cells comprising a heterologous polynucleotide encoding a polypeptide with phosphoketolase activity and host cells comprising a heterologous polynucleotide encoding a polypeptide with phosphotransacetylase activity are described in U.S. Provisional Patent Application No. 61/356,379 (incorporated herein by reference).

Disclosed in U.S. Provisional Application No. 61/380,563 (incorporated herein by reference) is a recombinant host cell comprising a pyruvate-utilizing biosynthetic pathway and a heterologous polynucleotide encoding a polypeptide which catalyzes the conversion of a step in a pyruvate-utilizing biosynthetic pathway wherein the polynucleotide is integrated into the chromosome and wherein wherein the step in the biosynthetic pathway is the conversion of pyruvate to acetolactate. U.S. application Ser. No. 12/893,089 (incorporated herein by reference) describes a recombinant yeast production host cell comprising a genetic modification which has the effect of reducing glucose repression wherein the genetic modification which has the effect of reducing glucose repression is a modification of a gene encoding a protein selected from the group consisting of nuclear and cytoplasmic localized hexokinase, transcription activator Hap1, transcription repressor Mig1, transcription repressor Mig2, and SCF ubiquitin-ligase complex component GRR1. Described in U.S. application Ser. No. 12/893,065, filed Sep. 29, 2010, (incorporated herein by reference) are lactic acid bacterial cells with reduced or eliminated and eliminated lactate dehydrogenase enzyme activity.

Construction of Production Host

Recombinant organisms containing the necessary genes that will encode the enzymatic pathway for the conversion of a fermentable carbon substrate to isobutanol may be constructed using techniques well known in the art. In the present invention, genes encoding the enzymes of one of the isobutanol biosynthetic pathways of the invention, for example, acetolactate synthase, acetohydroxy acid isomeroreductase, acetohydroxy acid dehydratase, branched-chain α-keto acid decarboxylase, and branched-chain alcohol dehydrogenase, may be isolated from various sources, as described above.

Methods of obtaining desired genes from a bacterial genome are common and well known in the art of molecular biology. For example, if the sequence of the gene is known, suitable genomic libraries may be created by restriction endonuclease digestion and may be screened with probes complementary to the desired gene sequence. Once the sequence is isolated, the DNA may be amplified using standard primer-directed amplification methods such as polymerase chain reaction (U.S. Pat. No. 4,683,202) to obtain amounts of DNA suitable for transformation using appropriate vectors. Tools for codon optimization for expression in a heterologous host are readily available. Some tools for codon optimization are available based on the GC content of the host organism. The GC content of some exemplary microbial hosts is given Table 3.

TABLE 3

GC Content of Microbial Hosts

| Strain | % GC |
| --- | --- |
| B. licheniformis | 46 |
| B. subtilis | 42 |
| C. acetobutylicum | 37 |
| E. coli | 50 |
| P. putida | 61 |
| A. eutrophus | 61 |
| Paenibacillus macerans | 51 |

TABLE 3-continued

GC Content of Microbial Hosts

| Strain | % GC |
| --- | --- |
| Rhodococcus erythropolis | 62 |
| Brevibacillus | 50 |
| Paenibacillus polymyxa | 50 |

Once the relevant pathway genes are identified and isolated they may be transformed into suitable expression hosts by means well known in the art. Vectors or cassettes useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. Both control regions may be derived from genes homologous to the transformed host cell, although it is to be understood that such control regions may also be derived from genes that are not native to the specific species chosen as a production host.

Initiation control regions or promoters, which are useful to drive expression of the relevant pathway coding regions in the desired host cell are numerous and familiar to those skilled in the art. Virtually any promoter capable of driving these genetic elements is suitable for the present invention including, but not limited to, CYC1, HIS3, GAL1, GAL10, ADH1, PGK, PHO5, GAPDH, ADC1, TRP1, URA3, LEU2, ENO, TPI, CUP1, FBA, GPD, and GPM (useful for expression in Saccharomyces); AOX1 (useful for expression in Pichia); and lac, ara, tet, trp, $IP_L$, $IP_R$, T7, tac, and trc (useful for expression in Escherichia coli, Alcaligenes, and Pseudomonas); the amy, apr, npr promoters and various phage promoters useful for expression in Bacillus subtilis, Bacillus licheniformis, and Paenibacillus macerans; nisA (useful for expression Gram-positive bacteria, Eichenbaum et al. Appl. Environ. Microbiol. 64(8):2763-2769 (1998)); and the synthetic P11 promoter (useful for expression in Lactobacillus plantarum, Rud et al., Microbiology 152:1011-1019 (2006)).

Termination control regions may also be derived from various genes native to the preferred hosts. Optionally, a termination site may be unnecessary, however, it is most preferred if included.

Certain vectors are capable of replicating in a broad range of host bacteria and can be transferred by conjugation. The complete and annotated sequence of pRK404 and three related vectors-pRK437, pRK442, and pRK442(H) are available. These derivatives have proven to be valuable tools for genetic manipulation in Gram-negative bacteria (Scott et al., Plasmid 50(1):74-79 (2003)). Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for the heterologous gene expression in Gram-negative bacteria.

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., J. Bacteriol. 174(17):5633-5638 (1992)).

Additionally, in vitro transposomes are available to create random mutations in a variety of genomes from commercial sources such as EPICENTRE®.

The expression of an isobutanol biosynthetic pathway in various preferred microbial hosts is described in more detail below.

Expression of an Isobutanol Biosynthetic Pathway in *E. coli*

Vectors or cassettes useful for the transformation of *E. coli* are common and commercially available from the companies listed above. For example, the genes of an isobutanol biosynthetic pathway may be isolated from various sources, cloned into a modified pUC19 vector and transformed into *E. coli* NM522, as described in Examples 6 and 7.

Expression of an Isobutanol Biosynthetic Pathway in *Rhodococcus Erythropolis*

A series of *E. coli-Rhodococcus* shuttle vectors are available for expression in *R. erythropolis*, including, but not limited to, pRhBR17 and pDA71 (Kostichka et al., *Appl. Microbiol. Biotechnol.* 62:61-68(2003)). Additionally, a series of promoters are available for heterologous gene expression in *R. erythropolis* (see for example Nakashima et al., *Appl. Environ. Microbiol.* 70:5557-5568 (2004), and Tao et al., *Appl. Microbiol. Biotechnol.* 2005, DOI 10.10071s00253-005-0064). Targeted gene disruption of chromosomal genes in *R. erythropolis* may be created using the method described by Tao et al., supra, and Brans et al. (*Appl. Environ. Microbiol.* 66: 2029-2036 (2000)).

The heterologous genes required for the production of isobutanol, as described above, may be cloned initially in pDA71 or pRhBR71 and transformed into *E. coli*. The vectors may then be transformed into *R. erythropolis* by electroporation, as described by Kostichka et al., supra. The recombinants may be grown in synthetic medium containing glucose and the production of isobutanol can be followed using methods known in the art.

Expression of an Isobutanol Biosynthetic Pathway in *B. Subtilis*

Methods for gene expression and creation of mutations in *B. subtilis* are also well known in the art. For example, the genes of an isobutanol biosynthetic pathway may be isolated from various sources, cloned into a modified pUC19 vector and transformed into *Bacillus subtilis* BE1010, as described in Example 8. Additionally, the five genes of an isobutanol biosynthetic pathway can be split into two operons for expression, as described in Example 20. The three genes of the pathway (bubB, ilvD, and kivD) were integrated into the chromosome of *Bacillus subtilis* BE1010 (Payne and Jackson, *J. Bacteriol.* 173:2278-2282 (1991)). The remaining two genes (ilvC and bdhB) were cloned into an expression vector and transformed into the Bacillus strain carrying the integrated isobutanol genes Expression of an Isobutanol Biosynthetic Pathway in *B. licheniformis*

Most of the plasmids and shuttle vectors that replicate in *B. subtilis* may be used to transform *B. licheniformis* by either protoplast transformation or electroporation. The genes required for the production of isobutanol may be cloned in plasmids pBE20 or pBE60 derivatives (Nagarajan et al., *Gene* 114:121-126 (1992)). Methods to transform *B. licheniformis* are known in the art (for example see Fleming et al. *Appl. Environ. Microbiol.,* 61(11):3775-3780 (1995)). The plasmids constructed for expression in *B. subtilis* may be transformed into *B. licheniformis* to produce a recombinant microbial host that produces isobutanol.

Expression of an Isobutanol Biosynthetic Pathway in *Paenibacillus Macerans*

Plasmids may be constructed as described above for expression in *B. subtilis* and used to transform *Paenibacillus macerans* by protoplast transformation to produce a recombinant microbial host that produces isobutanol.

Expression of the Isobutanol Biosynthetic Pathway in *Alcaliqenes* (*Ralstonia*) *Eutrophus*

Methods for gene expression and creation of mutations in *Alcaligenes eutrophus* are known in the art (see for example Taghavi et al., *Appl. Environ. Microbiol.,* 60(10):3585-3591 (1994)). The genes for an isobutanol biosynthetic pathway may be cloned in any of the broad host range vectors described above, and electroporated to generate recombinants that produce isobutanol. The poly(hydroxybutyrate) pathway in *Alcaligenes* has been described in detail, a variety of genetic techniques to modify the *Alcaligenes eutrophus* genome is known, and those tools can be applied for engineering an isobutanol biosynthetic pathway.

Expression of an Isobutanol Biosynthetic Pathway in *Pseudomonas Putida*

Methods for gene expression in *Pseudomonas putida* are known in the art (see for example Ben-Bassat et al., U.S. Pat. No. 6,586,229, which is incorporated herein by reference). The butanol pathway genes may be inserted into pPCU18 and this ligated DNA may be electroporated into electrocompetent *Pseudomonas putida* DOT-T1 C5aAR1 cells to generate recombinants that produce isobutanol.

Expression of an Isobutanol Biosynthetic Pathway in *Saccharomyces Cerevisiae*

Methods for gene expression in *Saccharomyces cerevisiae* are known in the art (see for example *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Expression of genes in yeast typically requires a promoter, followed by the gene of interest, and a transcriptional terminator. A number of yeast promoters can be used in constructing expression cassettes for genes encoding an isobutanol biosynthetic pathway, including, but not limited to constitutive promoters FBA, GPD, ADH1, and GPM, and the inducible promoters GAL1, GAL10, and CUP1. Suitable transcriptional terminators include, but are not limited to FBAt, GPDt, GPMt, ERG10t, GAL1t, CYC1, and ADH1. For example, suitable promoters, transcriptional terminators, and the genes of an isobutanol biosynthetic pathway may be cloned into *E. coli*-yeast shuttle vectors as described in Example 17.

Expression of an Isobutanol Biosynthetic Pathway in *Lactobacillus Plantarum*

The *Lactobacillus* genus belongs to the Lactobacillales family and many plasmids and vectors used in the transformation of *Bacillus subtilis* and *Streptococcus* may be used for lactobacillus. Non-limiting examples of suitable vectors include pAMβ1 and derivatives thereof (Renault et al., *Gene* 183:175-182 (1996); and O'Sullivan et al., *Gene* 137:227-231 (1993)); pMBB1 and pHW800, a derivative of pMBB1 (Wyckoff et al. *Appl. Environ. Microbiol.* 62:1481-1486 (1996)); pMG1, a conjugative plasmid (Tanimoto et al., *J. Bacteriol.* 184:5800-5804 (2002)); pNZ9520 (Kleerebezem et al., *Appl. Environ. Microbiol.* 63:4581-4584 (1997)); pAM401 (Fujimoto et al., *Appl. Environ. Microbiol.* 67:1262-1267 (2001)); and pAT392 (Arthur et al., *Antimicrob. Agents Chemother.* 38:1899-1903 (1994)). Several plasmids from *Lactobacillus plantarum* have also been reported (e.g., van Kranenburg R, Golic N, Bongers R, Leer R J, de Vos W M, Siezen R J, Kleerebezem M. *Appl. Environ. Microbiol.* 2005

March; 71(3): 1223-1230). For example, expression of an isobutanol biosynthetic pathway in *Lactobacillus plantarum* is described in Example 21.

Expression of an Isobutanol Biosynthetic Pathway in *Enterococcus faecium, Enterococcus qallinarium,* and *Enterococcus faecalis*

The *Enterococcus* genus belongs to the Lactobacillales family and many plasmids and vectors used in the transformation of *Lactobacillus, Bacillus subtilis,* and *Streptococcus* may be used for *Enterococcus*. Non-limiting examples of suitable vectors include pAMβ1 and derivatives thereof (Renault et al., *Gene* 183:175-182 (1996); and O'Sullivan et al., *Gene* 137:227-231 (1993)); pMBB1 and pHW800, a derivative of pMBB1 (Wyckoff et al. *Appl. Environ. Microbiol.* 62:1481-1486 (1996)); pMG1, a conjugative plasmid (Tanimoto et al., *J. Bacteriol.* 184:5800-5804 (2002)); pNZ9520 (Kleerebezem et al., *Appl. Environ. Microbiol.* 63:4581-4584 (1997)); pAM401 (Fujimoto et al., *Appl. Environ. Microbiol.* 67:1262-1267 (2001)); and pAT392 (Arthur et al., *Antimicrob. Agents Chemother.* 38:1899-1903 (1994)). Expression vectors for *E. faecalis* using the nisA gene from *Lactococcus* may also be used (Eichenbaum et al., *Appl. Environ. Microbiol.* 64:2763-2769 (1998). Additionally, vectors for gene replacement in the *E. faecium* chromosome may be used (Nallaapareddy et al., *Appl. Environ. Microbiol.* 72:334-345 (2006)). For example, expression of an isobutanol biosynthetic pathway in *Enterococcus faecalis* is described in Example 22.

Fermentation Media

Fermentation media in the present invention must contain suitable carbon substrates. Suitable substrates may include, but are not limited to, monosaccharides such as glucose and fructose, oligosaccharides such as lactose or sucrose, polysaccharides such as starch or cellulose or mixtures thereof and unpurified mixtures from renewable feedstocks such as cheese whey permeate, cornsteep liquor, sugar beet molasses, and barley malt. Additionally the carbon substrate may also be one-carbon substrates such as carbon dioxide, or methanol for which metabolic conversion into key biochemical intermediates has been demonstrated. In addition to one and two carbon substrates methylotrophic organisms are also known to utilize a number of other carbon containing compounds such as methylamine, glucosamine and a variety of amino acids for metabolic activity. For example, methylotrophic yeast are known to utilize the carbon from methylamine to form trehalose or glycerol (Bellion et al., *Microb. Growth C1 Compd.*, [Int. Symp.], 7th (1993), 415-32. Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence it is contemplated that the source of carbon utilized in the present invention may encompass a wide variety of carbon containing substrates and will only be limited by the choice of organism.

Although it is contemplated that all of the above mentioned carbon substrates and mixtures thereof are suitable in the present invention, preferred carbon substrates are glucose, fructose, and sucrose.

In addition to an appropriate carbon source, fermentation media must contain suitable minerals, salts, cofactors, buffers and other components, known to those skilled in the art, suitable for the growth of the cultures and promotion of the enzymatic pathway necessary for isobutanol production.

Culture Conditions

Typically cells are grown at a temperature in the range of about 25° C. to about 40° C. in an appropriate medium. Suitable growth media in the present invention are common commercially prepared media such as Luria Bertani (LB) broth, Sabouraud Dextrose (SD) broth or Yeast medium (YM) broth. Other defined or synthetic growth media may also be used, and the appropriate medium for growth of the particular microorganism will be known by one skilled in the art of microbiology or fermentation science. The use of agents known to modulate catabolite repression directly or indirectly, e.g., cyclic adenosine 2':3'-monophosphate, may also be incorporated into the fermentation medium.

Suitable pH ranges for the fermentation are between pH 5.0 to pH 9.0, where pH 6.0 to pH 8.0 is preferred as the initial condition.

Fermentations may be performed under aerobic or anaerobic conditions, where anaerobic or microaerobic conditions are preferred.

The amount of isobutanol produced in the fermentation medium can be determined using a number of methods known in the art, for example, high performance liquid chromatography (HPLC) or gas chromatography (GC).

Industrial Batch and Continuous Fermentations

The present process employs a batch method of fermentation. A classical batch fermentation is a closed system where the composition of the medium is set at the beginning of the fermentation and not subject to artificial alterations during the fermentation. Thus, at the beginning of the fermentation the medium is inoculated with the desired organism or organisms, and fermentation is permitted to occur without adding anything to the system. Typically, however, a "batch" fermentation is batch with respect to the addition of carbon source and attempts are often made at controlling factors such as pH and oxygen concentration. In batch systems the metabolite and biomass compositions of the system change constantly up to the time the fermentation is stopped. Within batch cultures cells moderate through a static lag phase to a high growth log phase and finally to a stationary phase where growth rate is diminished or halted. If untreated, cells in the stationary phase will eventually die. Cells in log phase generally are responsible for the bulk of production of end product or intermediate.

A variation on the standard batch system is the Fed-Batch system. Fed-Batch fermentation processes are also suitable in the present invention and comprise a typical batch system with the exception that the substrate is added in increments as the fermentation progresses. Fed-Batch systems are useful when catabolite repression is apt to inhibit the metabolism of the cells and where it is desirable to have limited amounts of substrate in the media. Measurement of the actual substrate concentration in Fed-Batch systems is difficult and is therefore estimated on the basis of the changes of measurable factors such as pH, dissolved oxygen and the partial pressure of waste gases such as $CO_2$. Batch and Fed-Batch fermentations are common and well known in the art and examples may be found in Thomas D. Brock in *Biotechnology: A Textbook of Industrial Microbiology*, Second Edition (1989) Sinauer Associates, Inc., Sunderland, Mass., or Deshpande, Mukund V., *Appl. Biochem. Biotechnol.,* 36:227, (1992), herein incorporated by reference.

Although the present invention is performed in batch mode it is contemplated that the method would be adaptable to continuous fermentation methods. Continuous fermentation is an open system where a defined fermentation medium is added continuously to a bioreactor and an equal amount of conditioned media is removed simultaneously for processing. Continuous fermentation generally maintains the cultures at a constant high density where cells are primarily in log phase growth.

Continuous fermentation allows for the modulation of one factor or any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by media turbidity, is kept constant. Continuous systems strive to maintain steady state growth conditions and thus the cell loss due to the medium being drawn off must be balanced against the cell growth rate in the fermentation. Methods of modulating nutrients and growth factors for continuous fermentation processes as well as techniques for maximizing the rate of product formation are well known in the art of industrial microbiology and a variety of methods are detailed by Brock, supra.

It is contemplated that the present invention may be practiced using either batch, fed-batch or continuous processes and that any known mode of fermentation would be suitable. Additionally, it is contemplated that cells may be immobilized on a substrate as whole cell catalysts and subjected to fermentation conditions for isobutanol production.

Methods for Isobutanol Isolation from the Fermentation Medium

The bioproduced isobutanol may be isolated from the fermentation medium using methods known in the art. For example, solids may be removed from the fermentation medium by centrifugation, filtration, decantation, or the like. Then, the isobutanol may be isolated from the fermentation medium, which has been treated to remove solids as described above, using methods such as distillation, liquid-liquid extraction, or membrane-based separation. Because isobutanol forms a low boiling point, azeotropic mixture with water, distillation can only be used to separate the mixture up to its azeotropic composition. Distillation may be used in combination with another separation method to obtain separation around the azeotrope. Methods that may be used in combination with distillation to isolate and purify isobutanol include, but are not limited to, decantation, liquid-liquid extraction, adsorption, and membrane-based techniques. Additionally, isobutanol may be isolated using azeotropic distillation using an entrainer (see for example Doherty and Malone, *Conceptual Design of Distillation Systems*, McGraw Hill, New York, 2001).

The isobutanol-water mixture forms a heterogeneous azeotrope so that distillation may be used in combination with decantation to isolate and purify the isobutanol. In this method, the isobutanol containing fermentation broth is distilled to near the azeotropic composition. Then, the azeotropic mixture is condensed, and the isobutanol is separated from the fermentation medium by decantation. The decanted aqueous phase may be returned to the first distillation column as reflux. The isobutanol-rich decanted organic phase may be further purified by distillation in a second distillation column.

The isobutanol may also be isolated from the fermentation medium using liquid-liquid extraction in combination with distillation. In this method, the isobutanol is extracted from the fermentation broth using liquid-liquid extraction with a suitable solvent. The isobutanol-containing organic phase is then distilled to separate the isobutanol from the solvent.

Distillation in combination with adsorption may also be used to isolate isobutanol from the fermentation medium. In this method, the fermentation broth containing the isobutanol is distilled to near the azeotropic composition and then the remaining water is removed by use of an adsorbent, such as molecular sieves (Aden et al. *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the isobutanol from the fermentation medium. In this method, the fermentation broth containing the isobutanol is distilled to near the azeotropic composition, and then the remaining water is removed by pervaporation through a hydrophilic membrane (Guo et al., *J. Membr. Sci.* 245, 199-210 (2004)).

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA and molecular cloning techniques used in the Examples are well known in the art and are described by Sambrook, J., Fritsch, E. F. and Maniatis, T. *Molecular Cloning: A Laboratory Manual*; Cold Spring Harbor Laboratory Press: Cold Spring Harbor, N.Y. (1989) (Maniatis) and by T. J. Silhavy, M. L. Bennan, and L. W. Enquist, *Experiments with Gene Fusions*, Cold Spring Harbor Laboratory Press, Cold Spring Harbor, N.Y. (1984) and by Ausubel, F. M. et al., *Current Protocols in Molecular Biology*, pub. by Greene Publishing Assoc. and Wiley-Interscience (1987).

Materials and methods suitable for the maintenance and growth of bacterial cultures are well known in the art. Techniques suitable for use in the following Examples may be found as set out in *Manual of Methods for General Bacteriology* (Phillipp Gerhardt, R. G. E. Murray, Ralph N. Costilow, Eugene W. Nester, Willis A. Wood, Noel R. Krieg and G. Briggs Phillips, eds), American Society for Microbiology, Washington, D.C. (1994)) or by Thomas D. Brock in *Biotechnology: A Textbook of Industrial Microbiology*, Second Edition, Sinauer Associates, Inc., Sunderland, Mass. (1989). All reagents, restriction enzymes and materials used for the growth and maintenance of bacterial cells were obtained from Aldrich Chemicals (Milwaukee, Wis.), BD Diagnostic Systems (Sparks, Md.), Life Technologies (Rockville, Md.), or Sigma Chemical Company (St. Louis, Mo.) unless otherwise specified.

Microbial strains were obtained from The American Type Culture Collection (ATCC), Manassas, Va., unless otherwise noted.

The oligonucleotide primers to use in the following Examples are given in Table 4. All the oligonucleotide primers are synthesized by Sigma-Genosys (Woodlands, Tex.).

TABLE 4

Oligonucleotide Cloning, Screening, and Sequencing Primers

| Name | Sequence | Description | SEQ ID NO: |
|---|---|---|---|
| N80 | CACCATGGACAAACAGTATCCGG TACGCC | budB forward | 11 |
| N81 | CGAAGGGCGATAGCTTTACCAAT CC | budB reverse | 12 |

TABLE 4-continued

Oligonucleotide Cloning, Screening, and Sequencing Primers

| Name | Sequence | Description | SEQ ID NO: |
|---|---|---|---|
| N100 | CACCATGGCTAACTACTTCAATACACTGA | ilvC forward | 13 |
| N101 | CCAGGAGAAGGCCTTGAGTGTTTTCTCC | ilvC reverse | 14 |
| N102 | CACCATGCCTAAGTACCGTTCCGCCACCA | ilvD forward | 15 |
| N103 | CGCAGCACTGCTCTTAAATATTCGGC | ilvD reverse | 16 |
| N104 | CACCATGAACAACTTTAATCTGCACACCC | yqhD forward | 17 |
| N105 | GCTTAGCGGGCGGCTTCGTATATACGGC | yqhD reverse | 18 |
| N110 | GCATGCCTTAAGAAAGGAGGGGGGTCACATGGACAAACAGTATCC | budB forward | 19 |
| N111 | ATGCATTTAATTAATTACAGAATCTGACTCAGATGCAGC | budB reverse | 20 |
| N112 | GTCGACGCTAGCAAAGGAGGAATCACCATGGCTAACTACTTCAA | ilvC forward | 21 |
| N113 | TCTAGATTAACCCGCAACAGCAATACGTTTC | ilvC reverse | 22 |
| N114 | TCTAGAAAAGGAGGAATAAAGTATGCCTAAGTACCGTTC | ilvD forward | 23 |
| N115 | GGATCCTTATTAACCCCCCAGTTTCGATTTA | ilvD reverse | 24 |
| N116 | GGATCCAAAGGAGGCTAGACATATGTATACTGTGGGGA | kivD forward | 25 |
| N117 | GAGCTCTTAGCTTTTATTTTGCTCCGCAAAC | kivD reverse | 26 |
| N118 | GAGCTCAAAGGAGGAGCAAGTAATGAACAACTTTAATCT | yqhD forward | 27 |
| N119 | GAATTCACTAGTCCTAGGTTAGCGGGCGGCTTCGTATATACGG | yqhD reverse | 28 |
| BenNF | CAACATTAGCGATTTTCTTTTCTCT | Npr forward | 29 |
| BenASR | CATGAAGCTTACTAGTGGGCTTAAGTTTTGAAAATAATGAAAACT | Npr reverse | 30 |
| N110.2 | GAGCTCACTAGTCAATTGTAAGTAAGTAAAAGGAGGTGGGTCACATGGACAAACAGTATCC | budB forward | 31 |
| N111.2 | GGATCCGATCGACTTAAGCCTCAGCTTACAGAATCTGACTCAGATGCAGC | budB reverse | 32 |
| N112.2 | GAGCTCCTTAAGAAGGAGGTAATCACCATGGCTAACTACTTCAA | ilvC forward | 33 |
| N113.2 | GGATCCGATCGAGCTAGCGGGCCGCTTAACCCGCAACAGCAATACGTTTC | ilvC reverse | 34 |
| N114.2 | GAGCTCGCTAGCAAGGAGGTATAAAGTATGCCTAAGTACCGTTC | ilvD forward | 35 |
| N115.2 | GGATCCGATCGATTAATTAACCTAAGGTTATTAACCCCCCAGTTTCGATTTA | ilvD reverse | 36 |
| N116.2 | GAGCTCTTAATTAAAAGGAGGTTAGACATATGTATACTGTGGGGA | kivD forward | 37 |
| N117.2 | GGATCCAGATCTCCTAGGACATGTTTAGCTTTTATTTTGCTCCGCAAAC | kivD reverse | 38 |
| N130SeqF1 | TGTTCCAACCTGATCACCG | sequencing primer | 40 |
| N130SeqF2 | GGAAAACAGCAAGGCGCT | sequencing primer | 41 |
| N130SeqF3 | CAGCTGAACCAGTTTGCC | sequencing primer | 42 |
| N130SeqF4 | AAAATACCAGCGCCTGTCC | sequencing primer | 43 |
| N130SeqR1 | TGAATGGCCACCATGTTG | sequencing primer | 44 |
| N130SeqR2 | GAGGATCTCCGCCGCCTG | sequencing primer | 45 |
| N130SeqR3 | AGGCCGAGCAGGAAGATC | sequencing primer | 46 |
| N130SeqR4 | TGATCAGGTTGGAACAGCC | sequencing primer | 47 |
| N131SeqF1 | AAGAACTGATCCCACAGGC | sequencing primer | 48 |
| N131SeqF2 | ATCCTGTGCGGTATGTTGC | sequencing primer | 49 |
| N131SeqF3 | ATTGCGATGGTGAAAGCG | sequencing primer | 50 |
| N131SeqR1 | ATGGTGTTGGCAATCAGCG | sequencing primer | 51 |
| N131SeqR2 | GTGCTTCGGTGATGGTTT | sequencing primer | 52 |
| N131SeqR3 | TTGAAACCGTGCGAGTAGC | sequencing primer | 53 |
| N132SeqF1 | TATTCACTGCCATCTCGCG | sequencing primer | 54 |
| N132SeqF2 | CCGTAAGCAGCTGTTCCT | sequencing primer | 55 |
| N132SeqF3 | GCTGGAACAATACGACGTTA | sequencing primer | 56 |
| N132SeqF4 | TGCTCTACCCAACCAGCTTC | sequencing primer | 57 |
| N132SeqR1 | ATGGAAAGACCAGAGGTGCC | sequencing primer | 58 |
| N132SeqR2 | TGCCTGTGTGGTACGAAT | sequencing primer | 59 |

TABLE 4-continued

Oligonucleotide Cloning, Screening, and Sequencing Primers

| Name | Sequence | Description | SEQ ID NO: |
|---|---|---|---|
| N132SeqR3 | TATTACGCGGCAGTGCACT | sequencing primer | 60 |
| N132SeqR4 | GGTGATTTTGTCGCAGTTAGAG | sequencing primer | 61 |
| N133SeqF1 | TCGAAATTGTTGGGTCGC | sequencing primer | 62 |
| N133SeqF2 | GGTCACGCAGTTCATTTCTAAG | sequencing primer | 63 |
| N133SeqF3 | TGTGGCAAGCCGTAGAAA | sequencing primer | 64 |
| N133SeqF4 | AGGATCGCGTGGTGAGTAA | sequencing primer | 65 |
| N133SeqR1 | GTAGCCGTCGTTATTGATGA | sequencing primer | 66 |
| N133SeqR2 | GCAGCGAACTAATCAGAGATTC | sequencing primer | 67 |
| N133SeqR3 | TGGTCCGATGTATTGGAGG | sequencing primer | 68 |
| N133SeqR4 | TCTGCCATATAGCTCGCGT | sequencing primer | 69 |
| Scr1 | CCTTTCTTTGTGAATCGG | sequencing primer | 72 |
| Src2 | AGAAACAGGGTGTGATCC | sequencing primer | 73 |
| Src3 | AGTGATCATCACCTGTTGCC | sequencing primer | 74 |
| Src4 | AGCACGGCGAGAGTCGACGG | sequencing primer | 75 |
| T-budB (BamHI) | AGATAGATGGATCCGGAGGTGG GTCACATGGACAAACAGT | budB forward | 144 |
| B-kivD (BamHI) | CTCTAGAGGATCCAGACTCCTAG GACATG | kivD reverse | 145 |
| T-groE (XhoI) | AGATAGATCTCGAGAGCTATTGT AACATAATCGGTACGGGGTG | PgroE forward | 147 |
| B-groEL (SpeI, BamH1) | ATTATGTCAGGATCCACTAGTTTT CCTCCTTTAATTGGGAATTGTTAT CCGC | PgroE reverse | 148 |
| T-groEL | AGCTATTGTAACATAATCGGTAC GGGGGTG | PgroE forward | 149 |
| T-ilvCB.s. (BamHI) | ACATTGATGGATCCCATAACAAG GGAGAGATTGAAATGGTAAAAG | ilvC forward | 150 |
| B-ilvCB.s. (SpeIBamHI) | TAGACAACGGATCCACTAGTTTA ATTTTGCGCAACGGAGACCACCG C | ilvC reverse | 151 |
| T-BD64 (DraIII) | TTACCGTGGACTCACCGAGTGG GTAACTAGCCTCGCCGGAAAGA GCG | pBD64 forward | 152 |
| B-BD64 (DraIII) | TCACAGTTAAGACACCTGGTGCC GTTAATGCGCCATGACAGCCATG AT | pBD64 reverse | 153 |
| T-laclq (DraIII) | ACAGATAGATCACCAGGTGCAAG CTAATTCCGGTGGAAACGAGGTC ATC | laclq forward | 154 |
| B-laclq (DraIII) | ACAGTACGATACACGGGGTGTCA CTGCCCGCTTTCCAGTCGGGAAA CC | laclq reverse | 155 |
| T-groE (DraIII) | TCGGATTACGCACCCCGTGAGCT ATTGTAACATAATCGGTACGGGG GTG | PgroE forward | 156 |
| B-B.s.ilvC (DraIII) | CTGCTGATCTCACACCGTGTGTT AATTTTGCGCAACGGAGACCACC GC | ilvC reverse | 157 |
| T-bdhB (DraIII) | TCGATAGCATACACACGGTGGTT AACAAAGGAGGGGTTAAAATGGT TGATTTCG | bdhB forward | 159 |
| B-bdhB (rrnBT1 DraIII) | ATCTACGCACTCGGTGATAAAAC GAAAGGCCCAGTCTTTCGACTGA GCCTTTCGTTTTATCTTACACAGA TTTTTTGAATATTTGTAGGAC | bdhB reverse | 160 |
| LDH EcoRV F | GACGTCATGACCACCCGCCGATCC CTTTT | ldhL forward | 161 |
| LDH AatIIR | GATATCCAACACCAGCGACCGACG TATTAC | ldhL reverse | 162 |
| Cm F | ATTTAAATCTCGAGTAGAGGATCC CAACAAACGAAAATTGGATAAAG | Cm forward | 163 |
| Cm R | ACGCGTTATTATAAAAGCCAGTCA TTAGG | Cm reverse | 164 |
| P11 F-StuI | CCTAGCGCTATAGTTGTTGACAG AATGGACATACTATGATATATTGT TGCTATAGCGA | P11 promoter forward | 165 |
| P11 R-SpeI | CTAGTCGCTATAGCAACAATATA TCATAGTATGTCCATTCTGTCAAC AACTATAGCGCTAGG | P11 promoter reverse | 166 |
| PldhL F-HindIII | AAGCTTGTCGACAAACCAACATT ATGACGTGTCTGGGC | ldhL forward | 167 |
| PldhL R-BamHI | GGATCCTCATCCTCTCGTAGTGA AAATT | ldhL reverse | 168 |
| F-bdhB-AvrII | TTCCTAGGAAGGAGGTGGTTAAA ATGGTTGATTTCG | bdhB forward | 169 |
| R-bdhB-BamHI | TTGGATCCTTACACAGATTTTTTG AATAT | bdhB reverse | 170 |
| F-ilvC (B.s.)-AflIII | AACTTAAGAAGGAGGTGATTGAA ATGGTAAAAGTATATT | ilvC forward | 171 |
| R-ilvC (B.s.)-NotI | AAGCGGCCGCTTAATTTTGCGCA ACGGAGACC | ivlC reverse | 172 |
| F-PnisA (HindIII) | TTAAGCTTGACATACTTGAATGAC CTAGTC | nisA promoter forward | 173 |
| R-PnisA (SpeI BamHI) | TTGGATCCAAACTAGTATAATTTA TTTTGTAGTTCCTTC | nisA promoter reverse | 174 |

Methods for Determining Isobutanol Concentration in Culture Media

The concentration of isobutanol in the culture media can be determined by a number of methods known in the art. For example, a specific high performance liquid chromatography (HPLC) method utilized a Shodex SH-1011 column with a Shodex SH-G guard column, both purchased from Waters Corporation (Milford, Mass.), with refractive index (RI) detection. Chromatographic separation was achieved using 0.01 M $H_2SO_4$ as the mobile phase with a flow rate of 0.5 mL/min and a column temperature of 50° C. Isobutanol had a retention time of 46.6 min under the conditions used. Alternatively, gas chromatography (GC) methods are available. For example, a specific GC method utilized an HP-INNOWax column (30 m×0.53 mm id, 1 μm film thickness, Agilent Technologies, Wilmington, Del.), with a flame ionization detector (FID). The carrier gas was helium at a flow rate of 4.5 mL/min, measured at 150° C. with constant head pressure; injector split was 1:25 at 200° C.; oven temperature was 45° C. for 1 min, 45 to 220° C. at 10° C./min, and 220° C. for 5 min; and FID detection was employed at 240° C. with 26 mL/min helium makeup gas. The retention time of isobutanol was 4.5 min.

The meaning of abbreviations is as follows: "s" means second(s), "min" means minute(s), "h" means hour(s), "psi" means pounds per square inch, "nm" means nanometers, "d" means day(s), "μL" means microliter(s), "mL" means milliliter(s), "L" means liter(s), "mm" means millimeter(s), "nm" means nanometers, "mM" means millimolar, "μM" means micromolar, "M" means molar, "mmol" means millimole(s), "μmol" means micromole(s)", "g" means gram(s), "μg" means microgram(s) and "ng" means nanogram(s), "PCR" means polymerase chain reaction, "OD" means optical density, "$OD_{600}$" means the optical density measured at a wavelength of 600 nm, "kDa" means kilodaltons, "g" means the gravitation constant, "bp" means base pair(s), "kbp" means kilobase pair(s), "% w/v" means weight/volume percent, % v/v" means volume/volume percent, "IPTG" means isopropyl-β-D-thiogalactopyranoiside, "RBS" means ribosome binding site, "HPLC" means high performance liquid chromatography, and "GC" means gas chromatography. The term "molar selectivity" is the number of moles of product produced per mole of sugar substrate consumed and is reported as a percent.

Example 1

Cloning and Expression of Acetolactate Synthase

The purpose of this Example was to clone the budB gene from *Klebsiella pneumoniae* and express it in *E. coli* BL21-AI. The budB gene was amplified from *Klebsiella pneumoniae* strain ATCC 25955 genomic DNA using PCR, resulting in a 1.8 kbp product.

Genomic DNA was prepared using the Gentra Puregene kit (Gentra Systems, Inc., Minneapolis, Minn.; catalog number D-5000A). The budB gene was amplified from *Klebsiella pneumoniae* genomic DNA by PCR using primers N80 and N81 (see Table 2), given as SEQ ID NOs:11 and 12, respectively. Other PCR amplification reagents were supplied in manufacturers' kits, for example, Finnzymes Phusion™ High-Fidelity PCR Master Mix (New England Biolabs Inc., Beverly, Mass.; catalog no. F-531) and used according to the manufacturer's protocol. Amplification was carried out in a DNA Thermocycler GeneAmp 9700 (PE Applied Biosystems, Foster city, Calif.).

For expression studies the Gateway cloning technology (Invitrogen Corp., Carlsbad, Calif.) was used. The entry vector pENTRSDD-TOPO allowed directional cloning and provided a Shine-Dalgarno sequence for the gene of interest. The destination vector pDEST14 used a T7 promoter for expression of the gene with no tag. The forward primer incorporated four bases (CACC) immediately adjacent to the translational start codon to allow directional cloning into pENTRSDD-TOPO (Invitrogen) to generate the plasmid pENTRSDD-TOPObudB. The pENTR construct was transformed into *E. coli* Top10 (Invitrogen) cells and plated according to manufacturer's recommendations. Transformants were grown overnight and plasmid DNA was prepared using the QIAprep Spin Miniprep kit (Qiagen, Valencia, Calif.; catalog no. 27106) according to manufacturer's recommendations. Clones were sequenced to confirm that the genes inserted in the correct orientation and to confirm the sequence. The nucleotide sequence of the open reading frame (ORF) for this gene and the predicted amino acid sequence of the enzyme are given as SEQ ID NO:1 and SEQ ID NO:2, respectively.

To create an expression clone, the budB gene was transferred to the pDEST 14 vector by recombination to generate pDEST14budB. The pDEST14budB vector was transformed into *E. coli* BL21-AI cells (Invitrogen). Transformants were inoculated into Luria Bertani (LB) medium supplemented with 50 μg/mL of ampicillin and grown overnight. An aliquot of the overnight culture was used to inoculate 50 mL of LB supplemented with 50 μg/mL of ampicillin. The culture was incubated at 37° C. with shaking until the $OD_{600}$ reached 0.6-0.8. The culture was split into two 25-mL cultures and arabinose was added to one of the flasks to a final concentration of 0.2% w/v. The negative control flask was not induced with arabinose. The flasks were incubated for 4 h at 37° C. with shaking. Cells were harvested by centrifugation and the cell pellets were resuspended in 50 mM MOPS, pH 7.0 buffer. The cells were disrupted either by sonication or by passage through a French Pressure Cell. The whole cell lysate was centrifuged yielding the supernatant or cell free extract and the pellet or the insoluble fraction. An aliquot of each fraction (whole cell lysate, cell free extract and insoluble fraction) was resuspended in SDS (MES) loading buffer (Invitrogen), heated to 85° C. for 10 min and subjected to SDS-PAGE analysis (NuPAGE 4-12% Bis-Tris Gel, catalog no. NP0322Box, Invitrogen). A protein of the expected molecular weight of about 60 kDa, as deduced from the nucleic acid sequence, was present in the induced culture but not in the uninduced control.

Acetolactate synthase activity in the cell free extracts is measured using the method described by Bauerle et al. (*Biochim. Biophys. Acta* 92(1):142-149 (1964)).

Example 2

Prophetic

Cloning and Expression of Acetohydroxy Acid Reductoisomerase

The purpose of this prophetic Example is to describe how to clone the ilvC gene from *E. coli* K12 and express it in *E. coli* BL21-AI. The ilvC gene is amplified from *E. coli* genomic DNA using PCR.

The ilvC gene is cloned and expressed in the same manner as the budB gene described in Example 1. Genomic DNA from *E. coli* is prepared using the Gentra Puregene kit (Gentra Systems, Inc., Minneapolis, Minn.; catalog number D-5000A). The ilvC gene is amplified by PCR using primers N100 and N101 (see Table 2), given as SEQ ID NOs:13 and 14, respectively, creating a 1.5 kbp product. The forward primer incorporates four bases (CCAC) immediately adjacent to the translational start codon to allow directional cloning into pENTR/SD/D-TOPO (Invitrogen) to generate the plasmid pENTRSDD-TOPOilvC. Clones are sequenced to confirm that the genes are inserted in the correct orientation and to confirm the sequence. The nucleotide sequence of the open reading frame (ORF) for this gene and the predicted amino acid sequence of the enzyme are given as SEQ ID NO:3 and SEQ ID NO:4, respectively.

To create an expression clone, the ilvC gene is transferred to the pDEST 14 (Invitrogen) vector by recombination to generate pDEST14ilvC. The pDEST14ilvC vector is transformed into E. coli BL21-AI cells and expression from the T7 promoter is induced by addition of arabinose. A protein of the expected molecular weight of about 54 kDa, as deduced from the nucleic acid sequence, is present in the induced culture, but not in the uninduced control.

Acetohydroxy acid reductoisomerase activity in the cell free extracts is measured using the method described by Arlin and Umbarger (*J. Biol. Chem.* 244(5):1118-1127 (1969)).

Example 3

Prophetic

Cloning and Expression of Acetohydroxy Acid Dehydratase

The purpose of this prophetic Example is to describe how to clone the ilvD gene from E. coli K12 and express it in E. coli BL21-AI. The ilvD gene is amplified from E. coli genomic DNA using PCR.

The ilvD gene is cloned and expressed in the same manner as the budB gene described in Example 1. Genomic DNA from E. coli is prepared using the Gentra Puregene kit (Gentra Systems, Inc., Minneapolis, Minn.; catalog number D-5000A). The ilvD gene is amplified by PCR using primers N102 and N103 (see Table 2), given as SEQ ID NOs:15 and 16, respectively, creating a 1.9 kbp product. The forward primer incorporates four bases (CCAC) immediately adjacent to the translational start codon to allow directional cloning into pENTR/SD/D-TOPO (Invitrogen) to generate the plasmid pENTRSDD-TOPOilvD. Clones are submitted for sequencing to confirm that the genes are inserted in the correct orientation and to confirm the sequence. The nucleotide sequence of the open reading frame (ORF) for this gene and the predicted amino acid sequence of the enzyme are given as SEQ ID NO:5 and SEQ ID NO:6, respectively.

To create an expression clone, the ilvD gene is transferred to the pDEST 14 (Invitrogen) vector by recombination to generate pDEST14ilvD. The pDEST14ilvD vector is transformed into E. coli BL21-AI cells and expression from the T7 promoter is induced by addition of arabinose. A protein of the expected molecular weight of about 66 kDa, as deduced from the nucleic acid sequence, is present in the induced culture, but not in the uninduced control.

Acetohydroxy acid dehydratase activity in the cell free extracts is measured using the method described by Flint et al. (*J. Biol. Chem.* 268(20):14732-14742 (1993)).

Example 4

Prophetic

Cloning and Expression of Branched-Chain Keto Acid Decarboxylase

The purpose of this prophetic example is to describe how to clone the kivD gene from *Lactococcus lactis* and express it in E. coli BL21-AI.

A DNA sequence encoding the branched-chain keto acid decarboxylase (kivD) from *L. lactis* is obtained from GenScript (Piscataway, N.J.). The sequence obtained is codon-optimized for expression in both E. coli and *B. subtilis* and is cloned into pUC57, to form pUC57-kivD. The codon-optimized nucleotide sequence of the open reading frame (ORF) for this gene and the predicted amino acid sequence of the enzyme are given as SEQ ID NO:7 and SEQ ID NO:8, respectively.

To create an expression clone NdeI and BamHI restriction sites are utilized to clone the 1.7 kbp kivD fragment from pUC57-kivD into vector pET-3a (Novagen, Madison, Wis.). This creates the expression clone pET-3a-kivD. The pET-3a-kivD vector is transformed into E. coli BL21-AI cells and expression from the T7 promoter is induced by addition of arabinose. A protein of the expected molecular weight of about 61 kDa, as deduced from the nucleic acid sequence, is present in the induced culture, but not in the uninduced control.

Branched-chain keto acid decarboxylase activity in the cell free extracts is measured using the method described by Smit et al. (*Appl. Microbiol. Biotechnol.* 64:396-402 (2003)).

Example 5

Prophetic

Cloning and Expression of Branched-Chain Alcohol Dehydrogenase

The purpose of this prophetic Example is to describe how to clone the yqhD gene from E. coli K12 and express it in E. coli BL21-AI. The yqhD gene is amplified from E. coli genomic DNA using PCR.

The yqhD gene is cloned and expressed in the same manner as the budB gene described in Example 1. Genomic DNA from E. coli is prepared using the Gentra Puregene kit (Gentra Systems, Inc., Minneapolis, Minn.; catalog number D-5000A). The yqhD gene is amplified by PCR using primers N104 and N105 (see Table 2), given as SEQ ID NOs:17 and 18, respectively, creating a 1.2 kbp product. The forward primer incorporates four bases (CCAC) immediately adjacent to the translational start codon to allow directional cloning into pENTR/SD/D-TOPO (Invitrogen) to generate the plasmid pENTRSDD-TOPOyqhD. Clones are submitted for sequencing to confirm that the genes are inserted in the correct orientation and to confirm the sequence. The nucleotide sequence of the open reading frame (ORF) for this gene and the predicted amino acid sequence of the enzyme are given as SEQ ID NO 9 and SEQ ID NO:10, respectively.

To create an expression clone, the yqhD gene is transferred to the pDEST 14 (Invitrogen) vector by recombination to generate pDEST14yqhD. The pDEST14ilvD vector is transformed into E. coli BL21-AI cells and expression from the T7 promoter is induced by addition of arabinose. A protein of the expected molecular weight of about 42 kDa, as deduced from the nucleic acid sequence, is present in the induced culture, but not in the uninduced control.

Branched-chain alcohol dehydrogenase activity in the cell free extracts is measured using the method described by Sulzenbacher et al. (*J. Mol. Biol.* 342(2):489-502 (2004)).

Example 6

Prophetic

Construction of a Transformation Vector for the Genes in an Isobutanol Biosynthetic Pathway The purpose of this prophetic Example is to describe how to construct a transformation vector comprising the genes encoding the five steps in an isobutanol biosynthetic pathway. All genes are placed in a single operon under the control of a single promoter. The individual genes are amplified by PCR with primers that incorporate restriction sites for later cloning and the forward primers contain an optimized *E. coli* ribosome binding site (AAAGGAGG). PCR products are TOPO cloned into the pCR 4Blunt-TOPO vector and transformed into *E. coli* Top10 cells (Invitrogen). Plasmid DNA is prepared from the TOPO clones and the sequence of the genes is verified. Restriction enzymes and T4 DNA ligase (New England Biolabs, Beverly, Mass.) are used according to manufacturer's recommendations. For cloning experiments, restriction fragments are gel-purified using QIAquick Gel Extraction kit (Qiagen). After confirmation of the sequence, the genes are subcloned into a modified pUC19 vector as a cloning platform. The pUC19 vector is modified by HindIII/SapI digestion, creating pUC19dHS. The digest removes the lac promoter adjacent to the MCS (multiple cloning site), preventing transcription of the operons in the vector.

The budB gene is amplified from *K. pneumoniae* ATCC 25955 genomic DNA by PCR using primer pair N110 and N111 (see Table 2), given as SEQ ID NOs:19 and 20, respectively, creating a 1.8 kbp product. The forward primer incorporates SphI and AflII restriction sites and a ribosome binding site (RBS). The reverse primer incorporates PacI and NsiI restriction sites. The PCR product is cloned into pCR4 Blunt-TOPO creating pCR4 Blunt-TOPO-budB. Plasmid DNA is prepared from the TOPO clones and the sequence of the gene is verified.

The ilvC gene is amplified from *E. coli* K12 genomic DNA by PCR using primer pair N112 and N113 (see Table 2) given as SEQ ID NOs:21 and 22, respectively, creating a 1.5 kbp product. The forward primer incorporates SalI and NheI restriction sites and a RBS. The reverse primer incorporates a XbaI restriction site. The PCR product is cloned into pCR4 Blunt-TOPO creating pCR4 Blunt-TOPO-ilvC. Plasmid DNA is prepared from the TOPO clones and the sequence of the gene is verified.

The ilvD gene is amplified from *E. coli* K12 genomic DNA by PCR using primer pair N114 and N115 (see Table 2) given as SEQ ID NOs:23 and 24, respectively, creating a 1.9 kbp product. The forward primer incorporates a XbaI restriction site and a RBS. The reverse primer incorporates a BamHI restriction site. The PCR product is cloned into pCR4 Blunt-TOPO creating pCR4 Blunt-TOPO-ilvD. Plasmid DNA is prepared from the TOPO clones and the sequence of the gene is verified.

The kivD gene is amplified from pUC57-kivD (described in Example 4) by PCR using primer pair N116 and N117 (see Table 2), given as SEQ ID NOs:25 and 26, respectively, creating a 1.7 bp product. The forward primer incorporates a BamHI restriction site and a RBS. The reverse primer incorporates a SacI restriction site. The PCR product is cloned into pCR4 Blunt-TOPO creating pCR4 Blunt-TOPO-kivD. Plasmid DNA is prepared from the TOPO clones and the sequence of the gene is verified.

The yqhD gene is amplified from *E. coli* K12 genomic DNA by PCR using primer pair N118 and N119 (see Table 2) given as SEQ ID NOs:27 and 28, respectively, creating a 1.2 kbp product. The forward primer incorporates a SacI restriction site. The reverse primer incorporates SpeI and EcoRI restriction sites. The PCR product is cloned into pCR4 Blunt-TOPO creating pCR4 Blunt-TOPO-yqhD. Plasmid DNA is prepared from the TOPO clones and the sequence of the gene is verified.

To construct the isobutanol pathway operon, the yqhD gene is excised from pCR4 Blunt-TOPO-yqhD with SacI and EcoRI, releasing a 1.2 kbp fragment. This is ligated with pUC19dHS, which has previously been digested with SacI and EcoRI. The resulting clone, pUC19dHS-yqhD, is confirmed by restriction digest. Next, the ilvC gene is excised from pCR4 Blunt-TOPO-ilvC with SalI and XbaI, releasing a 1.5 kbp fragment. This is ligated with pUC19dHS-yqhD, which has previously been digested with SalI and XbaI. The resulting clone, pUC19dHS-ilvC-yqhD, is confirmed by restriction digest. The budB gene is then excised from pCR4 Blunt-TOPO-budB with SphI and NsiI, releasing a 1.8 kbp fragment. pUC19dHS-ilvC-yqhD is digested with SphI and PstI and ligated with the SphI/NsiI budB fragment (NsiI and PstI generate compatible ends), forming pUC19dHS-budB-ilvC-yqhD. A 1.9 kbp fragment containing the ilvD gene is excised from pCR4 Blunt-TOPO-ilvD with XbaI and BamHI and ligated with pUC19dHS-budB-ilvC-yqhD, which is digested with these same enzymes, forming pUC19dHS-budB-ilvC-ilvD-yqhD. Finally, kivD is excised from pCR4 Blunt-TOPO-kivD with BamHI and SacI, releasing a 1.7 kbp fragment. This fragment is ligated with pUC19dHS-budB-ilvC-ilvD-yqhD, which has previously been digested with BamHI and SacI, forming pUC19dHS-budB-ilvC-ilvD-kivD-yqhD.

The pUC19dHS-budB-ilvC-ilvD-kivD-yqhD vector is digested with AflII and SpeI to release a 8.2 kbp operon fragment that is cloned into pBenAS, an *E. coli-B. subtilis* shuttle vector. Plasmid pBenAS is created by modification of the pBE93 vector, which is described by Nagarajan, (WO 93/24631, Example 4). To make pBenAS the *Bacillus amyloliquefaciens* neutral protease promoter (NPR), signal sequence, and the phoA gene are removed with a NcoI/HindIII digest of pBE93. The NPR promoter is PCR amplified from pBE93 by primers BenNF and BenASR, given as SEQ ID NOS:29 and 30, respectively. Primer BenASR incorporates AflII, SpeI, and HindIII sites downstream of the promoter. The PCR product is digested with NcoI and HindIII and the fragment is cloned into the corresponding sites in the vector creating pBenAS. The operon fragment is subcloned into the AflII and SpeI sites in pBenAS creating pBen-budB-ilvC-ilvD-kivD-yqhD.

Example 7

Prophetic

Expression of the Isobutanol Biosynthetic Pathway in *E. coli*

The purpose of this prophetic Example is to describe how to express an isobutanol biosynthetic pathway in *E. coli*.

The plasmid pBen-budB-ilvC-ilvD-kivD-yqhD, constructed as described in Example 6, is transformed into *E. coli*

NM522 (ATCC No. 47000) to give *E. coli* strain NM522/pBen-budB-ilvC-ilvD-kivD-yqhD and expression of the genes in the operon is monitored by SDS-PAGE analysis, enzyme assay and Western blot analysis. For Western blots, antibodies are raised to synthetic peptides by Sigma-Genosys (The Woodlands, Tex.).

*E. coli* strain NM522/pBen-budB-ilvC-ilvD-kivD-yqhD is inoculated into a 250 mL shake flask containing 50 mL of medium and shaken at 250 rpm and 35° C. The medium is composed of: glucose (5 g/L), MOPS (0.05 M), ammonium sulfate (0.01 M), potassium phosphate, monobasic (0.005 M), S10 metal mix (1% (v/v)) yeast extract (0.1% (w/v)), casamino acids (0.1% (w/v)), thiamine (0.1 mg/L), proline (0.05 mg/L), and biotin (0.002 mg/L), and is titrated to pH 7.0 with KOH. S10 metal mix contains: $MgCl_2$ (200 mM), $CaCl_2$ (70 mM), $MnCl_2$ (5 mM), $FeCl_3$ (0.1 mM), $ZnCl_2$ (0.1 mM), thiamine hydrochloride (0.2 mM), $CuSO_4$ (172 μM), $CoCl_2$ (253 μM), and $Na_2MoO_4$ (242 μM). After 18 h, isobutanol is detected by HPLC or GC analysis, using methods that are well known in the art, for example, as described in the General Methods section above.

Example 8

Prophetic

Expression of the Isobutanol Biosynthetic Pathway in *Bacillus subtilis*

The purpose of this prophetic Example is to describe how to express an isobutanol biosynthetic pathway in *Bacillus subtilis*. The same approach as described in Example 7 is used.

The plasmid pBen-budB-ilvC-ilvD-kivD-yqhD, constructed as described in Example 6, is used. This plasmid is transformed into *Bacillus subtilis* BE1010 (*J. Bacteriol.* 173: 2278-2282 (1991)) to give *B. subtilis* strain BE1010/pBen-budB-ilvC-ilvD-kivD-yqhD and expression of the genes in each operon is monitored as described in Example 7.

*B. subtilis* strain BE1010/pBen-budB-ilvC-ilvD-kivD-yqhD is inoculated into a 250 mL shake flask containing 50 mL of medium and shaken at 250 rpm and 35° C. for 18 h. The medium is composed of: dextrose (5 g/L), MOPS (0.05 M), glutamic acid (0.02 M), ammonium sulfate (0.01 M), potassium phosphate, monobasic buffer (0.005 M), S10 metal mix (as described in Example 11, 1% (v/v)), yeast extract (0.1% (w/v)), casamino acids (0.1% (w/v)), tryptophan (50 mg/L), methionine (50 mg/L), and lysine (50 mg/L), and is titrated to pH 7.0 with KOH. After 18 h, isobutanol is detected by HPLC or GC analysis using methods that are well known in the art, for example, as described in the General Methods section above.

Example 9

Cloning and Expression of Acetolactate Synthase

To create another acetolactate synthase expression clone, the budB gene was cloned into the vector pTrc99A. The budB gene was first amplified from pENTRSDD-TOPObudB (described in Example 1) using primers (N110.2 and N111.2, given as SEQ ID NOs:31 and 32, respectively) that introduced SacI, SpeI and MfeI sites at the 5' end and BbvCI, AflII, and BamHI sites at the 3' end. The resulting 1.75 kbp PCR product was cloned into pCR4-Blunt TOPO (Invitrogen) and the DNA sequence was confirmed (using N130Seq sequencing primers F1-F4 and R1-R4, given as SEQ ID NOs:40-47, respectively). The budB gene was then excised from this vector using SacI and BamHI and cloned into pTrc99A (Amann et al. *Gene* 69(2):301-315 (1988)), generating pTrc99A::budB. The pTrc99A::budB vector was transformed into *E. coli* TOP10 cells and the transformants were inoculated into LB medium supplemented with 50 μg/mL of ampicillin and grown overnight at 37° C. An aliquot of the overnight culture was used to inoculate 50 mL of LB medium supplemented with 50 μg/mL of ampicillin. The culture was incubated at 37° C. with shaking until the $OD_{600}$ reached 0.6 to 0.8. Expression of budB from the Trc promoter was then induced by the addition of 0.4 mM IPTG. Negative control flasks were also prepared that were not induced with IPTG. The flasks were incubated for 4 h at 37° C. with shaking. Cell-free extracts were prepared as described in Example 1.

Acetolactate synthase activity in the cell free extracts was measured as described in Example 1. Three hours after induction with IPTG, an acetolactate synthase activity of 8 units/mg was detected. The control strain carrying only the pTrc99A plasmid exhibited 0.03 units/mg of acetolactate synthase activity.

Example 10

Cloning and Expression of Acetohydroxy Acid Reductoisomerase

The purpose of this Example was to clone the ilvC gene from *E. coli* K12 and express it in *E. coli* TOP10. The ilvC gene was amplified from *E. coli* K12 strain FM5 (ATCC 53911) genomic DNA using PCR.

The ilvC gene was cloned and expressed in a similar manner as described for the cloning and expression of ilvC in Example 2 above. PCR was used to amplify ilvC from the *E. coli* FM5 genome using primers N112.2 and N113.2 (SEQ ID NOs:33 and 34, respectively). The primers created SacI and AflII sites and an optimal RBS at the 5' end and NotI, NheI and BamHI sites at the 3' end of ilvC. The 1.5 kbp PCR product was cloned into pCR4Blunt TOPO according to the manufacturer's protocol (Invitrogen) generating pCR4Blunt TOPO::ilvC. The sequence of the PCR product was confirmed using sequencing primers (N131SeqF1-F3, and N131SeqR1-R3, given as SEQ ID NOs:48-53, respectively). To create an expression clone, the ilvC gene was excised from pCR4Blunt TOPO::ilvC using SacI and BamHI and cloned into pTrc99A. The pTrc99A::ilvC vector was transformed into *E. coli* TOP10 cells and expression from the Trc promoter was induced by addition of IPTG, as described in Example 9. Cell-free extracts were prepared as described in Example 1.

Acetohydroxy acid reductoisomerase activity in the cell free extracts was measured as described in Example 2. Three hours after induction with IPTG, an acetohydroxy acid reductoisomerase activity of 0.026 units/mg was detected. The control strain carrying only the pTrc99A plasmid exhibited less than 0.001 units/mg of acetohydroxy acid reductoisomerase activity.

Example 11

Cloning and Expression of Acetohydroxy Acid Dehydratase

The purpose of this Example was to clone the ilvD gene from *E. coli* K12 and express it in *E. coli* Top10. The ilvD gene was amplified from *E. coli* K12 strain FM5 (ATCC 53911) genomic DNA using PCR.

The ilvD gene was cloned and expressed in a similar manner as the ilvC gene described in Example 10. PCR was used to amplify ilvD from the *E. coli* FM5 genome using primers N114.2 and N115.2 (SEQ ID NOs:35 and 36, respectively). The primers created SacI and NheI sites and an optimal RBS at the 5' end and Bsu36I, PacI and BamHI sites at the 3' end of ilvD. The 1.9 kbp PCR product was cloned into pCR4Blunt TOPO according to the manufacturer's protocol (Invitrogen) generating pCR4Blunt TOPO::ilvD. The sequence of the PCR product was confirmed (sequencing primers N132SeqF1-F4 and N132SeqR1-R4, given as SEQ ID NOs: 54-61, respectively). To create an expression clone, the ilvD gene was excised from plasmid pCR4Blunt TOPO::ilvD using SacI and BamHI, and cloned into pTrc99A. The pTrc99A::ilvD vector was transformed into *E. coli* TOP10 cells and expression from the Trc promoter was induced by addition of IPTG, as described in Example 9. Cell-free extracts were prepared as described in Example 1.

Acetohydroxy acid dehydratase activity in the cell free extracts was measured as described in Example 3. Three hours after induction with IPTG, an acetohydroxy acid dehydratase activity of 46 units/mg was measured. The control strain carrying only the pTrc99A plasmid exhibited no detectable acetohydroxy acid dehydratase activity.

Example 12

Cloning and Expression of Branched-Chain Keto Acid Decarboxylase

The purpose of this Example was to clone the kivD gene from *Lactococcus lactis* and express it in *E. coli* TOP10.

The kivD gene was cloned and expressed in a similar manner as that described for ilvC in Example 10 above. PCR was used to amplify kivD from the plasmid pUC57-kivD (see Example 4, above) using primers N116.2 and N117.2 (SEQ ID NOs:37 and 38, respectively). The primers created SacI and PacI sites and an optimal RBS at the 5' end and PciI, AvrII, BglII and BamHI sites at the 3' end of kivD. The 1.7 kbp PCR product was cloned into pCR4Blunt TOPO according to the manufacturer's protocol (Invitrogen) generating pCR4Blunt TOPO::kivD. The sequence of the PCR product was confirmed using primers N133SeqF1-F4 and N133SeqR1-R4 (given as SEQ ID NOs:62-69, respectively). To create an expression clone, the kivD gene was excised from plasmid pCR4Blunt TOPO::kivD using SacI and BamHI, and cloned into pTrc99A. The pTrc99A::kivD vector was transformed into *E. coli* TOP10 cells and expression from the Trc promoter was induced by addition of IPTG, as described in Example 9. Cell-free extracts were prepared as described in Example 1.

Branched-chain keto acid decarboxylase activity in the cell free extracts was measured as described in Example 4, except that Purpald® reagent (Aldrich, Catalog No. 162892) was used to detect and quantify the aldehyde reaction products. Three hours after induction with IPTG, a branched-chain keto acid decarboxylase activity of greater than 3.7 units/mg was detected. The control strain carrying only the pTrc99A plasmid exhibited no detectable branched-chain keto acid decarboxylase activity.

Example 13

Expression of Branched-Chain Alcohol Dehydrogenase

*E. coli* contains a native gene (yqhD) that was identified as a 1,3-propanediol dehydrogenase (U.S. Pat. No. 6,514,733).

The YqhD protein has 40% identity to AdhB (encoded by adhB) from *Clostridium*, a putative NADH-dependent butanol dehydrogenase. The yqhD gene was placed under the constitutive expression of a variant of the glucose isomerase promoter 1.6GI (SEQ ID NO. 70) in *E. coli* strain MG1655 1.6yqhD::Cm (WO 2004/033646) using λ Red technology (Datsenko and Wanner, *Proc. Natl. Acad. Sci. U.S.A.* 97:6640 (2000)). MG1655 1.6yqhD::Cm contains a FRT-CmR-FRT cassette so that the antibiotic marker can be removed. Similarly, the native promoter was replaced by the 1.5GI promoter (WO 2003/089621) (SEQ ID NO. 71), creating strain MG1655 1.5GI-yqhD::Cm, thus, replacing the 1.6GI promoter of MG1655 1.6yqhD::Cm with the 1.5GI promoter.

Strain MG1655 1.5GI-yqhD::Cm was grown in LB medium to mid-log phase and cell free extracts were prepared as described in Example 1. This strain was found to have NADPH-dependent isobutyraldehyde reductase activity when the cell extracts were assayed by following the decrease in absorbance at 340 nm at pH 7.5 and 35° C.

To generate a second expression strain containing 1.5GI yqhD::Cm, a P1 lysate was prepared from MG1655 1.5GI yqhD::Cm and the cassette was transferred to BL21 (DE3) (Invitrogen) by transduction, creating BL21 (DE3) 1.5GI-yqhD::Cm.

Example 14

Construction of a Transformation Vector for the First Four Genes in an Isobutanol Biosynthetic Pathway The purpose of this Example was to construct a transformation vector comprising the first four genes (i.e., budB, ilvC, ilvD and kivD) in an isobutanol biosynthetic pathway.

To construct the transformation vector, first, the ilvC gene was obtained from pTrc99A::ilvC (described in Example 10) by digestion with AflII and BamHI and cloned into pTrc99A:: budB (described in Example 9), which was digested with AflII and BamHI to produce plasmid pTrc99A::budB-ilvC. Next, the ilvD and kivD genes were obtained from pTrc99A:: ilvD (described in Example 11) and pTrc99A::kivD (described in Example 12), respectively, by digestion with NheI and PacI (ilvD) and PacI and BamHI (kivD). These genes were introduced into pTrc99A::budB-ilvC, which was first digested with NheI and BamHI, by three-way ligation. The presence of all four genes in the final plasmid, pTrc99A:: budB-ilvC-ilvD-kivD, was confirmed by PCR screening and restriction digestion.

Example 15

Expression of an Isobutanol Biosynthetic Pathway in *E. Coli* Grown on Glucose

To create *E. coli* isobutanol production strains, pTrc99A:: budB-ilvC-ilvD-kivD (described in Example 14) was transformed into *E. coli* MG1655 1.5GI yqhD::Cm and *E. coli* BL21 (DE3) 1.5GI yqhD::Cm (described in Example 13). Transformants were initially grown in LB medium containing 50 μg/mL kanamycin and 100 μg/mL carbenicillin. The cells from these cultures were used to inoculate shake flasks (approximately 175 mL total volume) containing 50 or 170 mL of TM3a/glucose medium (with appropriate antibiotics) to represent high and low oxygen conditions, respectively. TM3a/glucose medium contained (per liter): glucose (10 g), $KH_2PO_4$ (13.6 g), citric acid monohydrate (2.0 g), $(NH_4)_2SO_4$ (3.0 g), $MgSO_4.7H_2O$ (2.0 g), $CaCl_2.2H_2O$ (0.2 g), ferric ammonium citrate (0.33 g), thiamine.HCl (1.0 mg), yeast extract (0.50 g), and 10 mL of trace elements solution. The pH was adjusted to 6.8 with NH$_4$OH. The trace elements solution contained: citric acid.H$_2$O (4.0 g/L), MnSO$_4$.H$_2$O (3.0 g/L), NaCl (1.0 g/L), FeSO$_4$.7H$_2$O (0.10 g/L), CoCl$_2$.6H$_2$O (0.10 g/L), ZnSO$_4$.7H$_2$O (0.10 g/L), CuSO$_4$.5H$_2$O (0.010 g/L), H$_3$BO$_3$ (0.010 g/L), and Na$_2$MoO$_4$. 2H$_2$O (0.010 g/L).

The flasks were inoculated at a starting OD$_{600}$ of $\leq$0.01 units and incubated at 34° C. with shaking at 300 rpm. The flasks containing 50 mL of medium were closed with 0.2 μm filter caps; the flasks containing 150 mL of medium were closed with sealed caps. IPTG was added to a final concentration of 0.04 mM when the cells reached an OD$_{600}$ of $\geq$0.4 units. Approximately 18 h after induction, an aliquot of the broth was analyzed by HPLC (Shodex Sugar SH1011 column (Showa Denko America, Inc. NY) with refractive index (RI) detection) and GC (Varian CP-WAX 58(FFAP) CB, 0.25 mm×0.2 μm×25 m (Varian, Inc., Palo Alto, Calif.) with flame ionization detection (FID)) for isobutanol content, as described in the General Methods section. No isobutanol was detected in control strains carrying only the pTrc99A vector (results not shown). Molar selectivities and titers of isobutanol produced by strains carrying pTrc99A::budB-ilvC-ilvD-kivD are shown in Table 5. Significantly higher titers of isobutanol were obtained in the cultures grown under low oxygen conditions.

TABLE 5

Production of Isobutanol by *E. coli* Strains Grown on Glucose

| Strain | O$_2$ Conditions | Isobutanol mM* | Molar Selectivity (%) |
|---|---|---|---|
| MG1655 1.5GI yqhD/ pTrc99A::budB-ilvC-ilvD-kivD | High | 0.4 | 4.2 |
| MG1655 1.5GI yqhD/ pTrc99A::budB-ilvC-ilvD-kivD | Low | 9.9 | 39 |
| BL21 (DE3) 1.5GI yqhD/ pTrc99A::budB-ilvC-ilvD-kivD | High | 0.3 | 3.9 |
| BL21 (DE3) 1.5GI yqhD/ pTrc99A::budB-ilvC-ilvD-kivD | Low | 1.2 | 12 |

*Determined by HPLC.

Example 16

Expression of an Isobutanol Biosynthetic Pathway in *E. Coli* Grown on Sucrose

Since the strains described in Example 15 were not capable of growth on sucrose, an additional plasmid was constructed to allow utilization of sucrose for isobutanol production. A sucrose utilization gene cluster cscBKA, given as SEQ ID NO:39, was isolated from genomic DNA of a sucrose-utilizing *E. coli* strain derived from ATCC strain 13281. The sucrose utilization genes (cscA, cscK, and cscB) encode a sucrose hydrolase (CscA), given as SEQ ID NO:139, D-fructokinase (CscK), given as SEQ ID NO:140, and sucrose permease (CscB), given as SEQ ID NO:141. The sucrose-specific repressor gene cscR was not included so that the three genes cscBKA were expressed constitutively from their native promoters in *E. coli*.

Genomic DNA from the sucrose-utilizing *E. coli* strain was digested to completion with BamHI and EcoRI. Fragments having an average size of about 4 kbp were isolated from an agarose gel and were ligated to plasmid pLitmus28 (New England Biolabs), digested with BamHI and EcoRI and transformed into ultracompetent *E. coli* TOP10F' cells (Invitrogen). The transformants were streaked onto MacConkey agar plates containing 1% sucrose and ampicillin (100 μg/mL) and screened for the appearance of purple colonies. Plasmid DNA was isolated from the purple transformants, and sequenced with M13 Forward and Reverse primers (Invitrogen), and Scr1-4 (given as SEQ ID NOs:72-75, respectively). The plasmid containing cscB, cscK, and cscA (cscBKA) genes was designated pScr1.

To create a sucrose utilization plasmid that was compatible with the isobutanol pathway plasmid (Example 14), the operon from pScr1 was subcloned into pBHR1 (MoBiTec, Goettingen, Germany). The cscBKA genes were isolated by digestion of pScr1 with XhoI (followed by incubation with Klenow enzyme to generate blunt ends) and then by digestion with AgeI. The resulting 4.2 kbp fragment was ligated into pBHR1 that had been digested with NaeI and AgeI, resulting in the 9.3 kbp plasmid pBHR1::cscBKA.

The sucrose plasmid pBHR1::cscBKA was transformed into *E. coli* BL21 (DE3) 1.5 yqhD/pTrc99A::budB-ilvC-ilvD-kivD and *E. coli* MG1655 1.5yqhD/pTrc99A::budB-ilvC-ilvD-kivD (described in Example 15) by electroporation. Transformants were first selected on LB medium containing 100 μg/mL ampicillin and 50 μg/mL kanamycin and then screened on MacConkey sucrose (1%) plates to confirm functional expression of the sucrose operon. For production of isobutanol, strains were grown in TM3a minimal defined medium (described in Example 15) containing 1% sucrose instead of glucose, and the culture medium was analyzed for the amount of isobutanol produced, as described in Example 15, except that samples were taken 14 h after induction. Again, no isobutanol was detected in control strains carrying only the pTrc99A vector (results not shown). Molar selectivities and titers of isobutanol produced by MG1655 1.5yqhD carrying pTrc99A::budB-ilvC-ilvD-kivD are shown in Table 6. Similar results were obtained with the analogous BL21 (DE3) strain.

TABLE 6

Production of Isobutanol by *E. coli* strain MG1655 1.5yqhD/pTrc99A::budB-ilvC-ilvD-kivD/pBHR1::cscBKA Grown on Sucrose

| O$_2$ Conditions | IPTG, mM | Isobutanol, mM* | Molar Selectivity, % |
|---|---|---|---|
| High | 0.04 | 0.17 | 2 |
| High | 0.4 | 1.59 | 21 |
| Low | 0.04 | 4.03 | 26 |
| Low | 0.4 | 3.95 | 29 |

*Determined by HPLC.

Example 17

Expression of Isobutanol Pathway Genes in *Saccharomyces Cerevisiae*

To express isobutanol pathway genes in *Saccharomyces cerevisiae*, a number of *E. coli*-yeast shuttle vectors were constructed. A PCR approach (Yu, et al. *Fungal Genet. Biol.* 41:973-981(2004)) was used to fuse genes with yeast promoters and terminators. Specifically, the GPD promoter (SEQ ID NO:76) and CYC1 terminator (SEQ ID NO:77) were fused to the alsS gene from *Bacillus subtilis* (SEQ ID NO:78), the FBA promoter (SEQ ID NO:79) and CYC1 terminator were fused to the ILV5 gene from *S. cerevisiae* (SEQ ID NO:80), the ADH1 promoter (SEQ ID NO:81) and ADH1 terminator (SEQ ID NO:82) were fused to the ILV3 gene from *S. cerevisiae* (SEQ ID NO:83), and the GPM promoter (SEQ ID NO:84) and ADH1 terminator were fused to the kivD gene from *Lactococcus lactis* (SEQ ID NO:7). The primers, given in Table 7, were designed to include restriction sites for cloning promoter/gene/terminator products into *E. coli*-yeast shuttle vectors from the pRS400 series (Christianson et al. *Gene* 110:119-122 (1992)) and for exchanging promoters between constructs. Primers for the 5' ends of ILV5 and ILV3 (N138 and N155, respectively, given as SEQ ID NOs: 95 and 107, respectively) generated new start codons to eliminate mitochondrial targeting of these enzymes.

All fused PCR products were first cloned into pCR4-Blunt by TOPO cloning reaction (Invitrogen) and the sequences were confirmed (using M13 forward and reverse primers (Invitrogen) and the sequencing primers provided in Table 7. Two additional promoters (CUP1 and GAL1) were cloned by TOPO reaction into pCR4-Blunt and confirmed by sequencing; primer sequences are indicated in Table 7. The plasmids that were constructed are described in Table 8. The plasmids were transformed into either *Saccharomyces cerevisiae* BY4743 (ATCC 201390) or YJR148w (ATCC 4036939) to assess enzyme specific activities using the enzyme assays described in Examples 1-4 and Examples 9-12. For the determination of enzyme activities, cultures were grown to an $OD_{600}$ of 1.0 in synthetic complete medium (*Methods in Yeast Genetics*, 2005, Cold Spring Harbor Laboratory Press, Cold Spring Harbor, N.Y., pp. 201-202) lacking any metabolite(s) necessary for selection of the expression plasmid(s), harvested by centrifugation (2600×g for 8 min at 4° C.), washed with buffer, centrifuged again, and frozen at −80° C. The cells were thawed, resuspended in 20 mM Tris-HCl, pH 8.0 to a final volume of 2 mL, and then disrupted using a bead beater with 1.2 g of glass beads (0.5 mm size). Each sample was processed on high speed for 3 minutes total (with incubation on ice after each minute of beating). Extracts were cleared of cell debris by centrifugation (20,000×g for 10 min at 4° C.).

TABLE 7

Primer Sequences for Cloning and Sequencing of *S. cerevisiae* Expression Vectors

| Name | Sequence | Description | SEQ ID NO: |
|---|---|---|---|
| N98SeqF1 | CGTGTTAGTCACATCAGGAC | B. subtilis alsS sequencing primer | 85 |
| N98SeqF2 | GGCCATAGCAAAAATCCAAACAGC | B. subtilis alsS sequencing primer | 86 |
| N98SeqF3 | CCACGATCAATCATATCGAACACG | B. subtilis alsS sequencing primer | 87 |
| N98SeqF4 | GGTTTCTGTCTCTGGTGACG | B. subtilis alsS sequencing primer | 88 |
| N99SeqR1 | GTCTGGTGATTCTACGCGCAAG | B. subtilis alsS sequencing primer | 89 |
| N99SeqR2 | CATCGACTGCATTACGCAACTC | B. subtilis alsS sequencing primer | 90 |
| N99SeqR3 | CGATCGTCAGAACAACATCTGC | B. subtilis alsS sequencing primer | 91 |
| N99SeqR4 | CCTTCAGTGTTCGCTGTCAG | B. subtilis alsS sequencing primer | 92 |
| N136 | CCGCGGATAGATCTGAAATGAATAACAATACTGACA | FBA promoter forward primer with SacII/BglII sites | 93 |
| N137 | TACCACCGAAGTTGATTTGCTTCAACATCCTCAGCTCTAGATTTGAATATGTATTACTTGGTTAT | FBA promoter reverse primer with BbvCI site and ILV5-annealing region | 94 |
| N138 | ATGTTGAAGCAAATCAACTTCGGTGGTA | ILV5 forward primer (creates alternate start codon) | 95 |
| N139 | TTATTGGTTTTCTGGTCTCAAC | ILV5 reverse primer | 96 |
| N140 | AAGTTGAGACCAGAAAACCAATAATTAATTAATCATGTAATTAGTTATGTCACGCTT | CYC terminator forward primer with PacI site and ILV5-annealing region | 97 |
| N141 | GCGGCCGCCCGCAAATTAAAGCCTTCGAGC | CYC terminator reverse primer with NotI site | 98 |
| N142 | GGATCCGCATGCTTGCATTTAGTCGTGC | GPM promoter forward primer with BamHI site | 99 |
| N143 | CAGGTAATCCCCCACAGTATACATCCTCAGCTATTGTAATATGTGTTTGTTTGG | GPM promoter reverse primer with BbvCI site and kivD-annealing region | 100 |
| N144 | ATGTATACTGTGGGGGATTACC | kivD forward primer | 101 |
| N145 | TTAGCTTTTATTTTGCTCCGCA | kivD reverse primer | 102 |
| N146 | TTTGCGGAGCAAAATAAAAGCTAATTAATTAAGAGTAAGCGAATTTCTTATGATTTA | ADH terminator forward primer with PacI site and kivD-annealing region | 103 |
| N147 | ACTAGTACCACAGGTGTTGTCCTCTGAG | ADH terminator reverse primer with SpeI site | 104 |
| N151 | CTAGAGAGCTTTCGTTTTCATG | alsS reverse primer | 105 |

TABLE 7-continued

Primer Sequences for Cloning and Sequencing of S. cerevisiae Expression Vectors

| Name | Sequence | Description | SEQ ID NO: |
|---|---|---|---|
| N152 | CTCATGAAAACGAAAGCTC TCTAGTTAATTAATCATGT AATTAGTTATGTCACGCTT | CYC terminator forward primer with PacI site and alsS-annealing region | 106 |
| N155 | ATGGCAAAGAAGCTCAACA AGTACT | ILV3 forward primer (alternate start codon) | 107 |
| N156 | TCAAGCATCTAAAACACAA CCG | ILV3 reverse primer | 108 |
| N157 | AACGGTTGTGTTTTAGATG CTTGATTAATTAAGAGTAA GCGAATTTCTTATGATTTA | ADH terminator forward primer with PacI site and ILV3-annealing region | 109 |
| N158 | GGATCCTTTTCTGGCAACC AAACCCATA | ADH promoter forward primer with BamHI site | 110 |
| N159 | CGAGTACTTGTTGAGCTTC TTTGCCATCCTCAGCGAGA TAGTTGATTGTATGCTTG | ADH promoter reverse primer with BbvCI site and ILV3-annealing region | 111 |
| N160SeqF1 | GAAAACGTGGCATCCTCTC | FBA::ILV5::CYC sequencing primer | 112 |
| N160SeqF2 | GCTGACTGGCCAAGAGAA A | FBA::ILV5::CYC sequencing primer | 113 |
| N160SeqF3 | TGTACTTCTCCCACGGTTT C | FBA::ILV5::CYC sequencing primer | 114 |
| N160SeqF4 | AGCTACCCAATCTCTATAC CCA | FBA::ILV5::CYC sequencing primer | 115 |
| N160SeqF5 | CCTGAAGTCTAGGTCCCTA TTT | FBA::ILV5::CYC sequencing primer | 116 |
| N160SeqR1 | GCGTGAATGTAAGCGTGA C | FBA::ILV5::CYC sequencing primer | 117 |
| N160SeqR2 | CGTCGTATTGAGCCAAGAA C | FBA::ILV5::CYC sequencing primer | 118 |
| N160SeqR3 | GCATCGGACAACAAGTTCA T | FBA::ILV5::CYC sequencing primer | 119 |
| N160SeqR4 | TCGTTCTTGAAGTAGTCCA ACA | FBA::ILV5::CYC sequencing primer | 120 |
| N160SeqR5 | TGAGCCCGAAAGAGAGGA T | FBA::ILV5::CYC sequencing primer | 121 |
| N161SeqF1 | ACGGTATACGGCCTTCCTT | ADH::ILV3::ADH sequencing primer | 122 |
| N161SeqF2 | GGGTTTGAAAGCTATGCAG T | ADH::ILV3::ADH sequencing primer | 123 |
| N161SeqF3 | GGTGGTATGTATACTGCCA ACA | ADH::ILV3::ADH sequencing primer | 124 |
| N161SeqF4 | GGTGGTACCCAATCTGTGA TTA | ADH::ILV3::ADH sequencing primer | 125 |
| N161SeqF5 | CGGTTTGGGTAAAGATGTT G | ADH::ILV3::ADH sequencing primer | 126 |
| N161SeqF6 | AAACGAAAATTCTTATTCT TGA | ADH:ILV3::ADH sequencing primer | 127 |
| N161SeqR1 | TCGTTTTAAAACCTAAGAG TCA | ADH::ILV3::ADH sequencing primer | 128 |
| N161SeqR2 | CCAAACCGTAACCCATCAG | ADH::ILV3::ADH sequencing primer | 129 |
| N161SeqR3 | CACAGATTGGGTACCACCA | ADH::ILV3::ADH sequencing primer | 130 |
| N161SeqR4 | ACCACAAGAACCAGGACCT G | ADH::ILV3::ADH sequencing primer | 131 |
| N161SeqR5 | CATAGCTTTCAAACCCGCT | ADH::ILV3::ADH sequencing primer | 132 |
| N161SeqR6 | CGTATACCGTTGCTCATTA GAG | ADH::ILV3::ADH sequencing primer | 133 |
| N162 | ATGTTGACAAAAGCAACAA AAGA | alsS forward primer | 134 |
| N189 | ATCCGCGGATAGATCTAGT TCGAGTTTATCATTATCAA | GPD forward primer with SacII/BglII sites | 135 |
| N190.1 | TTCTTTTGTTGCTTTTGTC AACATCCTCAGCGTTTATG TGTGTTTATTCGAAA | GPD promoter reverse primer with BbvCI site and alsS-annealing region | 136 |
| N176 | ATCCGCGGATAGATCTATT AGAAGCCGCCGAGCGGGC G | GAL1 promoter forward primer with SacII/BglII sites | 137 |

TABLE 7-continued

Primer Sequences for Cloning and Sequencing of S. cerevisiae Expression Vectors

| Name | Sequence | Description | SEQ ID NO: |
|---|---|---|---|
| N177 | ATCCTCAGCTTTTCTCCTT GACGTTAAAGTA | GAL1 promoter reverse with BbvCI site | 138 |
| N191 | ATCCGCGGATAGATCTCCC ATTACCGACATTTGGGCGC | CUP1 promoter forward primer with SacII/BglII sites | 175 |
| N192 | ATCCTCAGCGATGATTGAT TGATTGATTGTA | CUP1 promoter reverse with BbvCI site | 176 |

TABLE 8

E. coli-Yeast Shuttle Vectors Carrying Isobutanol Pathway Genes

| Plasmid Name | Construction |
|---|---|
| pRS426 [ATCC No. 77107], URA3 selection | — |
| pRS426::GPD::alsS::CYC | GPD::alsS::CYC PCR product digested with SacII/NotI cloned into pRS426 digested with same |
| pRS426::FBA::ILV5::CYC | FBA::ILV5::CYC PCR product digested with SacII/NotI cloned into pRS426 digested with same |
| pRS425 [ATCC No. 77106], LEU2 selection | — |
| pRS425::ADH::ILV3::ADH | ADH::ILV3::ADH PCR product digested with BamHI/SpeI cloned into pRS425 digested with same |
| pRS425::GPM::kivD::ADH | GPM::kivD::ADH PCR product digested with BamHI/SpeI cloned into pRS425 digested with same |
| pRS426::CUP1::alsS | 7.7 kbp SacII/BbvCI fragment from pRS426::GPD::alsS::CYC ligated with SacII/BbvCI CUP1 fragment |
| pRS426::GAL1::ILV5 | 7 kbp SacII/BbvCI fragment from pRS426::FBA::ILV5::CYC ligated with SacII/BbvCI GAL1 fragment |
| pRS425::FBA::ILV3 | 8.9 kbp BamHI/BbvCI fragment from pRS425::ADH::ILV3::ADH ligated with 0.65 kbp BglII/BbvCI FBA fragment from pRS426::FBA::ILV5::CYC |
| pRS425::CUP1-alsS + FBA-ILV3 | 2.4 kbp SacII/NotI fragment from pRS426::CUP1::alsS cloned into pRS425::FBA::ILV3 cut with SacII/NotI |
| pRS426::FBA-ILV5 + GPM-kivD | 2.7 kbp BamHI/SpeI fragment from pRS425::GPM::kivD::ADH cloned into pRS426::FBA::ILV5::CYC cut with BamHI/SpeI |
| pRS426::GAL1-FBA + GPM-kivD | 8.5 kbp SacII/NotI fragment from pRS426:: FBA-ILV5 + GPM-kivD ligated with 1.8 kbp SacII/NotI fragment from pRS426::GAL1::ILV5 |
| pRS423 [ATCC No. 77104], HIS3 selection | — |
| pRS423::CUP1-alsS + FBA-ILV3 | 5.2 kbp SacI/SalI fragment from pRS425::CUP1-alsS + FBA-ILV3 ligated into pRS423 cut with SacI/SalI |
| pHR81 [ATCC No. 87541], URA3 and leu2-d selection | — |
| pHR81::FBA-ILV5 + GPM-kivD | 4.7 kbp SacI/BamHI fragment from pRS426::FBA-ILV5 + GPM-kivD ligated into pHR81 cut with SacI/BamHI |

Example 18

Production of Isobutanol by Recombinant *Saccharomyces Cerevisiae*

Plasmids pRS423::CUP1-alsS+FBA-ILV3 and pHR81::FBA-ILV5+GPM-kivD (described in Example 17) were transformed into *Saccharomyces cerevisiae* YJR148w to produce strain YJR148w/pRS423::CUP1-alsS+FBA-ILV3/pHR81::FBA-ILV5+GPM-kivD. A control strain was prepared by transforming vectors pRS423 and pHR81 (described in Example 17) into *Saccharomyces cerevisiae* YJR148w (strain YJR148w/pRS423/pHR81). Strains were maintained on standard *S. cerevisiae* synthetic complete medium (*Methods in Yeast Genetics,* 2005, Cold Spring Harbor Laboratory Press, Cold Spring Harbor, N.Y., pp. 201-202) containing either 2% glucose or sucrose but lacking uracil and histidine to ensure maintenance of plasmids.

For isobutanol production, cells were transferred to synthetic complete medium lacking uracil, histidine and leucine. Removal of leucine from the medium was intended to trigger an increase in copy number of the pHR81-based plasmid due to poor transcription of the leu2-d allele (Erhart and Hollenberg, *J. Bacteriol.* 156:625-635 (1983)). Aerobic cultures were grown in 175 mL capacity flasks containing 50 mL of medium in an Innova4000 incubator (New Brunswick Scientific, Edison, N.J.) at 30° C. and 200 rpm. Low oxygen cultures were prepared by adding 45 mL of medium to 60 mL serum vials that were sealed with crimped caps after inoculation and kept at 30° C. Sterile syringes were used for sampling and addition of inducer, as needed. Approximately 24 h after inoculation, the inducer $CuSO_4$ was added to a final concentration of 0.03 mM. Control cultures for each strain without $CuSO_4$ addition were also prepared. Culture supernatants were analyzed 18 or 19 h and 35 h after $CuSO_4$ addition by both GC and HPLC for isobutanol content, as described above in Example 15. The results for *S. cerevisiae* YJR148w/pRS423::CUP1-alsS+FBA-ILV3/pHR81::FBA-ILV5+GPM-kivD grown on glucose are presented in Table 9. For the results given in Table 9, the samples from the aerobic cultures were taken at 35 h and the samples from the low oxygen cultures were taken at 19 h and measured by HPLC.

The results for *S. cerevisiae* YJR148w/pRS423::CUP1-alsS+FBA-ILV3/pHR81::FBA-ILV5+GPM-kivD grown on sucrose are presented in Table 10. The results in this table were obtained with samples taken at 18 h and measured by HPLC.

TABLE 9

Production of Isobutanol by *S. cerevisiae* YJR148w/pRS423::CUP1-alsS + FBA-ILV3/pHR81::FBA-ILV5 + GPM-kivD Grown on Glucose

| Strain | O₂ level | Iso-butanol, mM | Molar Selectivity % |
|---|---|---|---|
| YJR148w/pRS423/pHR81 (control) | Aerobic | 0.12 | 0.04 |
| YJR148w/pRS423/pHR81 (control) | Aerobic | 0.11 | 0.04 |
| YJR148w/pRS423::CUP1-alsS + FBA-ILV3/pHR81::FBA-ILV5 + GPM-kivD a | Aerobic | 0.97 | 0.34 |
| YJR148w/pRS423::CUP1-alsS + FBA-ILV3/pHR81::FBA-ILV5 + GPM-kivD b | Aerobic | 0.93 | 0.33 |
| YJR148w/pRS423::CUP1-alsS + FBA-ILV3/pHR81::FBA-ILV5 + GPM-kivD c | Aerobic | 0.85 | 0.30 |
| YJR148w/pRS423/pHR81 (control) | Low | 0.11 | 0.1 |
| YJR148w/pRS423/pHR81 (control) | Low | 0.08 | 0.1 |
| YJR148w/pRS423::CUP1-alsS + FBA-ILV3/pHR81::FBA-ILV5 + GPM-kivD a | Low | 0.28 | 0.5 |
| YJR148w/pRS423::CUP1-alsS + FBA-ILV3/pHR81::FBA-ILV5 + GPM-kivD b | Low | 0.20 | 0.3 |
| YJR148w/pRS423::CUP1-alsS + FBA-ILV3/pHR81::FBA-ILV5 + GPM-kivD c | Low | 0.33 | 0.6 |

TABLE 10

Production of Isobutanol by *S. cerevisiae* YJR148w/pRS423::CUP1-alsS + FBA-ILV3/pHR81::FBA-ILV5 + GPM-kivD Grown on Sucrose

| Strain | O₂ Level | Iso-butanol mM | Molar Selectivity, % |
|---|---|---|---|
| YJR148w/pRS423/pHR81 (control) | Aerobic | 0.32 | 0.6 |
| YJR148w/pRS423/pHR81 (control) | Aerobic | 0.17 | 0.3 |
| YJR148w/pRS423::CUP1-alsS + FBA-ILV3/pHR81::FBA-ILV5 + GPM-kivD a | Aerobic | 0.68 | 1.7 |
| YJR148w/pRS423::CUP1-alsS + FBA-ILV3/pHR81::FBA-ILV5 + GPM-kivD b | Aerobic | 0.54 | 1.2 |
| YJR148w/pRS423::CUP1-alsS + FBA-ILV3/pHR81::FBA-ILV5 + GPM-kivD c | Aerobic | 0.92 | 2.0 |
| YJR148w/pRS423/pHR81 (control) | Low | 0.18 | 0.3 |
| YJR148w/pRS423/pHR81 (control) | Low | 0.15 | 0.3 |
| YJR148w/pRS423::CUP1-alsS + FBA-ILV3/pHR81::FBA-ILV5 + GPM-kivD a | Low | 0.27 | 1.2 |
| YJR148w/pRS423::CUP1-alsS + FBA-ILV3/pHR81::FBA-ILV5 + GPM-kivD b | Low | 0.30 | 1.1 |
| YJR148w/pRS423::CUP1-alsS + FBA-ILV3/pHR81::FBA-ILV5 + GPM-kivD c | Low | 0.21 | 0.8 |

Strain suffixes "a", "b", and "c" indicate separate isolates.

The results indicate that, when grown on glucose or sucrose under both aerobic and low oxygen conditions, strain YJR148w/pRS423::CUP1-alsS+FBA-ILV3/pHR81::FBA-ILV5+GPM-kivD produced consistently higher levels of isobutanol than the control strain.

Example 19

Production of Isobutanol by Recombinant *Saccharomyces Cerevisiae*

Plasmids pRS425::CUP1-alsS+FBA-ILV3 and pRS426::GAL1-ILV5+GPM-kivD (described in Example 17) were transformed into *Saccharomyces cerevisiae* YJR148w to produce strain YJR148w/pRS425::CUP1-alsS+FBA-ILV3/pRS426::GAL1-ILV5+GPM-kivD. A control strain was prepared by transforming vectors pRS425 and pRS426 (described in Example 17) into *Saccharomyces cerevisiae* YJR148w (strain YJR148w/pRS425/pRS426). Strains were maintained on synthetic complete medium, as described in Example 18.

For isobutanol production, cells were transferred to synthetic complete medium containing 2% galactose and 1% raffinose, and lacking uracil and leucine. Aerobic and low oxygen cultures were prepared as described in Example 18. Approximately 12 h after inoculation, the inducer $CuSO_4$ was added up to a final concentration of 0.5 mM. Control cultures for each strain without $CuSO_4$ addition were also prepared. Culture supernatants were sampled 23 h after $CuSO_4$ addition for determination of isobutanol by HPLC, as described in Example 18. The results are presented in Table 11. Due to the widely different final optical densities observed and associated with quantifying the residual carbon source, the concentration of isobutanol per $OD_{600}$ unit (instead of molar selectivities) is provided in the table to allow comparison of strains containing the isobutanol biosynthetic pathway genes with the controls.

TABLE 11

Production of Isobutanol by *S. cerevisiae* YJR148w/
pRS425::CUP1-alsS + FBA-ILV3/pRS426::GAL1-ILV5 +
GPM-kivD Grown on Galactose and Raffinose

| Strain | O$_2$ level | CuSO$_4$, mM | Iso-butanol mM | mM Iso-butanol per OD unit |
|---|---|---|---|---|
| YJR148w/pRS425/pRS426 (control) | Aerobic | 0.1 | 0.12 | 0.01 |
| YJR148w/pRS425/pRS426 (control) | Aerobic | 0.5 | 0.13 | 0.01 |
| YJR148w/pRS425::CUP1-alsS + FBA-ILV3/pRS426::GAL1-ILV5 + GPM-kivD a | Aerobic | 0 | 0.20 | 0.03 |
| YJR148w/pRS425::CUP1-alsS + FBA-ILV3/pRS426::GAL1-ILV5 + GPM-kivD b | Aerobic | 0.03 | 0.82 | 0.09 |
| YJR148w/pRS425::CUP1-alsS + FBA-ILV3/pRS426::GAL1-ILV5 + GPM-kivD c | Aerobic | 0.1 | 0.81 | 0.09 |
| YJR148w/pRS425::CUP1-alsS + FBA-ILV3/pRS426::GAL1-ILV5 + GPM-kivD d | Aerobic | 0.5 | 0.16 | 0.04 |
| YJR148w/pRS425::CUP1-alsS + FBA-ILV3/pRS426::GAL1-ILV5 + GPM-kivD e | Aerobic | 0.5 | 0.18 | 0.01 |
| YJR148w/pRS425/pRS426 (control) | Low | 0.1 | 0.042 | 0.007 |
| YJR148w/pRS425/pRS426 (control) | Low | 0.5 | 0.023 | 0.006 |
| YJR148w/pRS425::CUP1-alsS + FBA-ILV3/pRS426::GAL1-ILV5 + GPM-kivD a | Low | 0 | 0.1 | 0.04 |
| YJR148w/pRS425::CUP1-alsS + FBA-ILV3/pRS426::GAL1-ILV5 + GPM-kivD b | Low | 0.03 | 0.024 | 0.02 |
| YJR148w/pRS425::CUP1-alsS + FBA-ILV3/pRS426::GAL1-ILV5 + GPM-kivD c | Low | 0.1 | 0.030 | 0.04 |
| YJR148w/pRS425::CUP1-alsS + FBA-ILV3/pRS426::GAL1-ILV5 + GPM-kivD d | Low | 0.5 | 0.008 | 0.02 |
| YJR148w/pRS425::CUP1-alsS + FBA-ILV3/pRS426::GAL1-ILV5 + GPM-kivD e | Low | 0.5 | 0.008 | 0.004 |

Strain suffixes "a", "b", "c", "d" and "e" indicate separate isolates.

The results indicate that in general, higher levels of isobutanol per optical density unit were produced by the YJR148w/pRS425::CUP1-alsS+FBA-ILV3/pRS426::GAL1-ILV5+GPM-kivD strain compared to the control strain under both aerobic and low oxygen conditions.

Example 20

Expression of an Isobutanol Biosynthetic Pathway in *Bacillus Subtilis*

The purpose of this Example was to express an isobutanol biosynthetic pathway in *Bacillus subtilis*. The five genes of the isobutanol pathway (pathway steps (a) through (e) in FIG. 1) were split into two operons for expression. The three genes budB, ilvD, and kivD, encoding acetolactate synthase, acetohydroxy acid dehydratase, and branched-chain keto acid decarboxylase, respectively, were integrated into the chromosome of *B. subtilis* BE1010 (Payne and Jackson, *J. Bacteriol.* 173:2278-2282 (1991)). The two genes ilvC and bdhB, encoding acetohydroxy acid isomeroreductase and butanol dehydrogenase, respectively, were cloned into an expression vector and transformed into the *Bacillus* strain carrying the integrated isobutanol genes.

Integration of the three genes, budB, ilvD and kivD into the chromosome of *B. subtilis* BE1010. *Bacillus* integration vectors pFP988DssPspac and pFP988DssPgroE were used for the chromosomal integration of the three genes, budB (SEQ ID NO:1), ilvD (SEQ ID NO:5), and kivD (SEQ ID NO:7). Both plasmids contain an *E. coli* replicon from pBR322, an ampicillin antibiotic marker for selection in *E. coli* and two sections of homology to the sacB gene in the *Bacillus* chromosome that direct integration of the vector and intervening sequence by homologous recombination. Between the sacB homology regions is a spac promoter (PgroE) on pFP988DssPspac or a groEL promoter (PgroE) on pFP988DssPgroE, and a selectable marker for *Bacillus*, erythromycin. The promoter region also contains the lacO sequence for regulation of expression by a lacI repressor protein. The sequences of pFP988DssPspac (6,341 bp) and pFP988DssPgroE (6,221 bp) are given as SEQ ID NO:142 and SEQ ID NO:143 respectively.

The cassette with three genes budB-ilvD-kivD was constructed by deleting the ilvC gene from plasmid pTrc99a budB-ilvC-ilvD-kivD. The construction of the plasmid pTrc99A::budB-ilvC-ilvD-kivD is described in Example 14. Plasmid pTrc99A::budB-ilvC-ilvD-kivD was digested with AflII and NheI, treated with the Klenow fragment of DNA polymerase to make blunt ends, and the resulting 9.4 kbp fragment containing pTrc99a vector, budB, ilvD, and kivD was gel-purified. The 9.4 kbp vector fragment was self-ligated to create pTrc99A::budB-ilvD-kivD, and transformed into DH5α competent cells (Invitrogen). A clone of pTrc99a budB-ilvD-kivD was confirmed for the ilvC gene deletion by restriction mapping. The resulting plasmid pTrc99A::budB-ilvD-kivD was digested with SacI and treated with the Klenow fragment of DNA polymerase to make blunt ends. The plasmid was then digested with BamHI and the resulting 5,297 bp budB-ilvD-kivD fragment was gel-purified. The 5,297 bp budB-ilvD-kivD fragment was ligated into the SmaI and BamHI sites of the integration vector pFP988DssPspac. The ligation mixture was transformed into DH5α competent cells. Transformants were screened by PCR amplification of the 5.3 kbp budB-ilvD-kivD fragment with primers T-budB (BamHI) (SEQ ID NO:144) and B-kivD(BamHI) (SEQ ID NO:145). The correct clone was named pFP988DssPspac-budB-ilvD-kivD.

Plasmid pFP988DssPspac-budB-ilvD-kivD was prepared from the *E. coli* transformant, and transformed into *B. subtilis* BE1010 competent cells, which had been prepared as described by Doyle et al. (*J. Bacteriol.* 144:957 (1980)). Competent cells were harvested by centrifugation and the cell pellets were resuspended in a small volume of the supernatant. To one volume of competent cells, two volumes of SPII-EGTA medium (*Methods for General and Molecular Bacteriology*, P. Gerhardt et al., Ed., American Society for Microbiology, Washington, D.C. (1994)) was added. Aliquots (0.3 mL) of cells were dispensed into test tubes and then 2 to 3 µg of plasmid pFP988DssPspac-budB-ilvD-kivD was added to the tubes. The tubes were incubated for 30 min at 37° C. with shaking, after which 0.1 mL of 10% yeast extract was added to each tube and they were further incubated for 60 min. Transformants were grown for selection on LB plates containing erythromycin (1.0 µg/mL) using the double agar overlay method (*Methods for General and Molecular Bacteriology*, supra). Transformants were screened by PCR amplification with primers N130SeqF1 (SEQ ID NO:40) and N130SeqR1 (SEQ ID NO:44) for budB, and N133SeqF1 (SEQ ID NO:62) and N133SeqR1 (SEQ ID NO:66) for kivD. Positive integrants showed the expected 1.7 kbp budB and 1.7 kbp kivD PCR products. Two positive integrants were identified and named *B. subtilis* BE1010 ΔsacB::Pspac-budB-ilvD-kivD #2-3-2 and *B. subtilis* BE1010 ΔsacB::Pspac-budB-ilvD-kivD #6-12-7.

Assay of the enzyme activities in integrants *B. subtilis* BE1010 ΔsacB::Pspac-budB-ilvD-kivD #2-3-2 and *B. subtilis* BE1010 ΔsacB::Pspac-budB-ilvD-kivD #6-12-7 indicated that the activities of BudB, IlvD and KivD were low under the control of the spac promoter (Pspac). To improve expression of functional enzymes, the Pspac promoter was replaced by a PgroE promoter from plasmid pHT01 (MoBitec, Goettingen, Germany).

A 6,039 bp pFP988Dss vector fragment, given as SEQ ID NO:146, was excised from an unrelated plasmid by restriction digestion with XhoI and BamHI, and was gel-purified. The PgroE promoter was PCR-amplified from plasmid pHT01 with primers T-groE(XhoI) (SEQ ID NO:147) and B-groEL(SpeI,BamH1) (SEQ ID NO:148). The PCR product was digested with XhoI and BamHI, ligated with the 6,039 bp pFP988Dss vector fragment, and transformed into DH5α competent cells. Transformants were screened by PCR amplification with primers T-groE(XhoI) and B-groEL(SpeI, BamH1). Positive clones showed the expected 174 bp PgroE PCR product and were named pFP988DssPgroE. The plasmid pFP988DssPgroE was also confirmed by DNA sequence.

Plasmid pFP988DssPspac-budB-ilvD-kivD was digested with SpeI and PmeI and the resulting 5,313 bp budB-ilvD-kivD fragment was gel-purified. The budB-ilvD-kivD fragment was ligated into SpeI and PmeI sites of pFP988DssPgroE and transformed into DH5α competent cells. Positive clones were screened for a 1,690 bp PCR product by PCR amplification with primers T-groEL (SEQ ID NO:149) and N111 (SEQ ID NO:20). The positive clone was named pFP988DssPgroE-budB-ilvD-kivD.

Plasmid pFP988DssPgroE-budB-ilvD-kivD was prepared from the *E. coli* transformant, and transformed into *Bacillus subtilis* BE1010 competent cells as described above. Transformants were screened by PCR amplification with primers N130SeqF1 (SEQ ID NO:40) and N130SeqR1 (SEQ ID NO:44) for budB, and N133SeqF1 (SEQ ID NO:62) and N133SeqR1 (SEQ ID NO:66) for kivD. Positive integrants showed the expected 1.7 kbp budB and 1.7 kbp kivD PCR products. Two positive integrants were isolated and named *B. subtilis* BE1010 ΔsacB::PgroE-budB-ilvD-kivD #1-7 and *B. subtilis* BE1010 ΔsacB::PgroE-budB-ilvD-kivD #8-16.

Plasmid Expression of ilvC and bdhB genes. Two remaining isobutanol genes, ilvC and bdhB, were expressed from a plasmid. Plasmid pHT01 (MoBitec), a *Bacillus-E. coli* shuttle vector, was used to fuse an ilvC gene from *B. subtilis* to a PgroE promoter so that the ilvC gene was expressed from the PgroE promoter containing a lacO sequence. The ilvC gene, given as SEQ ID NO:186, was PCR-amplified from *B. subtilis* BR151 (ATCC 33677) genomic DNA with primers T-ilvCB.s.(BamHI) (SEQ ID NO:150) and B-ilvCB.s.(SpeI BamHI) (SEQ ID NO:151). The 1,067 bp ilvC PCR product was digested with BamHI and ligated into the BamHI site of pHT01. The ligation mixture was transformed into DH5α competent cells. Positive clones were screened for a 1,188 bp PCR product by PCR amplification with primers T-groEL and B-ilvB.s.(SpeI BamHI). The positive clone was named pHT01-ilvC(B.s). Plasmid pHT01-ilvC(B.s) was used as a template for PCR amplification of the PgroE-ilvC fused fragment.

Plasmid pBD64 (Minton et al., *Nucleic Acids Res.* 18:1651 (1990)) is a fairly stable vector for expression of foreign genes in *B. subtilis* and contains a repB gene and chloramphenicol and kanamycin resistance genes for selection in *B. subtilis*. This plasmid was used for expression of ilvC and bdhB under the control of a PgroE promoter. To clone PgroE-ilvC, bdhB and a lacI repressor gene into plasmid pBD64, a one-step assembly method was used (Tsuge et al., *Nucleic Acids Res.* 31:e133 (2003)). A 3,588 bp pBD64 fragment containing a repB gene, which included the replication function, and the kanamycin antibiotic marker was PCR-amplified from pBD64 with primers T-BD64(DraIII) (SEQ ID NO:152), which introduced a DraIII sequence (CAC CGAGTG), and B-BD64(DraIII) (SEQ ID NO:153), which introduced a DraIII sequence (CACCTGGTG). A 1,327 bp lacI repressor gene was PCR-amplified from pMUTIN4 (Vagner et al., *Microbiol.* 144:3097-3104 (1998)) with T-lacIq(DraIII) (SEQ ID NO:154), which introduced a DraIII sequence (CACCAGGTG) and B-lacIq(DraIII) (SEQ ID NO:155), which introduced a DraIII sequence (CAC GGGGTG). A 1,224 bp PgroE-ilvC fused cassette was PCR-amplified from pHT01-ilvC(B.s) with T-groE(DraIII) (SEQ ID NO:156), which introduced a DraIII sequence (CAC CCCGTG), and B-B.s.ilvC(DraIII) (SEQ ID NO:157), which introduced a DraIII sequence (CACCGTGTG). A 1.2 kbp bdhB gene (SEQ ID NO:158) was PCR-amplified from *Clostridium acetobutylicum* (ATCC 824) genomic DNA with primers T-bdhB(DraIII) (SEQ ID NO:159), which introduced a DraIII sequence (CACACGGTG), and B-bdhB (rrnBT1DraIII) (SEQ ID NO:160), which introduced a DraIII sequence (CACTCGGTG). The three underlined letters in the variable region of the DraIII recognition sequences were designed for specific base-pairing to assemble the four fragments with an order of pBD64-lacI-PgroEilvC-bdhB. Each PCR product with DraIII sites at both ends was digested separately with DraIII, and the resulting DraIII fragments, 3,588 bp pBD64, lacI, PgroEilvC, and bdhB were gel-purified using a QIAGEN gel extraction kit (QIAGEN). A mixture containing an equimolar concentration of each fragment with a total DNA concentration of 30 to 50 µg/100 µL was prepared for ligation. The ligation solution was then incubated at 16° C. overnight. The ligation generated high molecular weight tandem repeat DNA. The ligated long, linear DNA mixture was directly transformed into competent *B. subtilis* BE1010, prepared as described above. *B. subtilis* preferentially takes up long repeated linear DNA forms, rather than circular DNA to establish a plasmid. After transformation the culture was spread onto an LB plate containing 10 µg/mL of kanamycin for selection. Positive recombinant plasmids were screened by DraIII digestion, giving four fragments with an expected size of 3,588 bp (pBD64), 1,327 bp (lacI), 1,224 bp (PgorE-ilvC), and 1,194 bp (bdhB). The positive plasmid was named pBDPgroE-ilvC(B.s.)-bdhB.

Demonstration of isobutanol production from glucose or sucrose by *B. subtilis* BE1010 AsacB::PgroE-budB-ilvD-kivD/gBDPgroE-ilvC(B.s.)-bdhB. To construct the recombinant *B. subtilis* expressing the five genes of the isobutanol biosynthetic pathway, competent cells of the two integrants *B. subtilis* BE1010 ΔsacB-PgroE-budB-ilvD-kivD #1-7 and *B. subtilis* BE1010 ΔsacB::PgroE-budB-ilvD-kivD #8-16 were prepared as described above, and transformed with plasmid pBDPgroE-ilvC(B.s.)-bdhB, yielding *B. subtilis* BE1010 ΔsacB::PgroE-budB-ilvD-kivD #1-7/pBDPgroE-ilvC(B.s.)-bdhB and *B. subtilis* BE1010 ΔsacB::PgroE-budB-ilvD-kivD #8-16/pBDPgroE-ilvC(B.s.)-bdhB.

The two recombinant strains were inoculated in either 25 mL or 100 mL of glucose medium containing kanamycin (10 µg/mL) in 125 mL flasks to simulate high and low oxygen conditions, respectively, and aerobically grown at 37° C. with shaking at 200 rpm. The medium consisted of 10 mM $(NH_4)_2SO_4$, 5 mM potassium phosphate buffer (pH 7.0), 100 mM MOPS/KOH buffer (pH 7.0), 20 mM glutamic acid/

KOH (pH 7.0), 2% S10 metal mix, 1% glucose, 0.01% yeast extract, 0.01% casamino acids, and 50 µg/mL each of L-tryptophan, L-methionine, and L-lysine. The S10 metal mix consisted of 200 mM $MgCl_2$, 70 mM $CaCl_2$, 5 mM $MnCl_2$, 0.1 mM $FeCl_3$, 0.1 mM $ZnCl_2$, 0.2 mM thiamine hydrochloride, 0.172 mM $CuSO_4$, 0.253 mM $CoCl_2$, and 0.242 mM $Na_2MoO_4$. The cells were induced with 1.0 mM isopropyl-β-D-thiogalactopyranoiside (IPTG) at early-log phase ($OD_{600}$ of approximately 0.2). At 24 h after inoculation, an aliquot of the broth was analyzed by HPLC (Shodex Sugar SH1011 column) with refractive index (RI) detection for isobutanol content, as described in the General Methods section. The HPLC results are shown in Table 12.

TABLE 12

Production of Isobutanol from Glucose by B. subtilis
BE1010 ΔsacB::PgroE-budB-ilvD-kivD/pBDPgroE-ilvC(B.s.)-bdhB Strains

| Strain | $O_2$ Level | isobutanol, mM | molar selectivity, % |
|---|---|---|---|
| B. subtilis a (induced) | high | 1.00 | 1.8 |
| B. subtilis b (induced) | high | 0.87 | 1.6 |
| B. subtilis a (induced) | low | 0.06 | 0.1 |
| B. subtilis b (induced) | low | 0.14 | 0.3 |

B. subtilis a is B. subtilis BE1010 ΔsacB::PgroE-budB-ilvD-kivD #1-7/pBDPgroE-ilvC (B.s.)-bdhB
B. subtilis b is B. subtilis BE1010 ΔsacB::PgroE-budB-ilvD-kivD #8-16/pBDPgroE-ilvC (B.s.)-bdhB The isolate of B. subtilis BE1010 ΔsacB::PgroE-budB-ilvD-kivD #1-7/pBDPgroE-ilvC(B.s.)-bdhB was also examined for isobutanol production from sucrose, essentially as described above. The recombinant strain was inoculated in 25 mL or 75 mL of sucrose medium containing kanamycin (10 µg/mL) in 125 mL flasks to simulate high and medium oxygen levels, and grown at 37° C. with shaking at 200 rpm. The sucrose medium was identical to the glucose medium except that glucose (10 g/L) was replaced with 10 g/L of sucrose. The cells were uninduced, or induced with 1.0 mM isopropyl-β-D-thiogalactopyranoiside (IPTG) at early-log phase ($OD_{600}$ of approximately 0.2). At 24 h after inoculation, an aliquot of the broth was analyzed by HPLC (Shodex Sugar SH1011 column) with refractive index (RI) detection for isobutanol content, as described in the General Methods section. The HPLC results are given in Table 13.

TABLE 13

Production of Isobutanol from Sucrose by B. subtilis
Strain BE1010 ΔsacB::PgroE-budB-ilvD-kivD/pBDPgroE-ilvC(B.s.)-bdhB

| Strain | $O_2$ Level | isobutanol, mM | molar selectivity, % |
|---|---|---|---|
| B. subtilis a (uninduced) | high | Not detected | Not detected |
| B. subtilis a (induced) | high | 0.44 | 4.9 |
| B. subtilis a (induced) | medium | 0.83 | 8.6 |

B. subtilis a is B. subtilis BE1010 ΔsacB::PgroE-budB-ilvD-kivD #1-7/pBDPgroE-ilvC (B.s.)-bdhB Example 21

Prophetic

Expression of an Isobutanol Biosynthetic Pathway in Lactobacillus Plantarum

The purpose of this prophetic Example is to describe how to express an isobutanol biosynthetic pathway in Lactobacillus plantarum. The five genes of the isobutanol pathway, encoding five enzyme activities, are divided into two operons for expression. The budB, ilvD and kivD genes, encoding the enzymes acetolactate synthase, acetohydroxy acid dehydratase, and branched-chain α-keto acid decarboxylase, respectively, are integrated into the chromosome of Lactobacillus plantarum by homologous recombination using the method described by Hols et al. (Appl. Environ. Microbiol. 60:1401-1413 (1994)). The remaining two genes (ilvC and bdhB, encoding the enzymes acetohydroxy acid reductoisomerase and butanol dehydrogenase, respectively) are cloned into an expression plasmid and transformed into the Lactobacillus strain carrying the integrated isobutanol genes. Lactobacillus plantarum is grown in MRS medium (Difco Laboratories, Detroit, Mich.) at 37° C., and chromosomal DNA is isolated as described by Moreira et al. (BMC Microbiol. 5:15 (2005)).

Integration. The budB-ilvD-kivD cassette under the control of the synthetic P11 promoter (Rud et al., Microbiology 152:1011-1019 (2006)) is integrated into the chromosome of Lactobacillus plantarum ATCC BAA-793 (NCIMB 8826) at the IdhL1 locus by homologous recombination. To build the IdhL integration targeting vector, a DNA fragment from Lactobacillus plantarum (Genbank NC_004567) with homology to IdhL is PCR amplified with primers LDH EcoRV F (SEQ ID NO:161) and LDH AatIIR (SEQ ID NO:162). The 1986 bp PCR fragment is cloned into pCR4Blunt-TOPO and sequenced. The pCR4Blunt-TOPO-IdhL1 clone is digested with EcoRV and AatII releasing a 1982 bp IdhL1 fragment that is gel-purified. The integration vector pFP988, given as SEQ ID NO:177, is digested with HindIII and treated with Klenow DNA polymerase to blunt the ends. The linearized plasmid is then digested with AatII and the 2931 bp vector fragment is gel purified. The EcoRV/AatII IdhL1 fragment is ligated with the pFP988 vector fragment and transformed into E. coli Top10 cells. Transformants are selected on LB agar plates containing ampicillin (100 µg/mL) and are screened by colony PCR to confirm construction of pFP988-IdhL.

To add a selectable marker to the integrating DNA, the Cm gene with its promoter is PCR amplified from pC194 (GenBank NC_002013, SEQ ID NO:267) with primers Cm F (SEQ ID NO:163) and Cm R (SEQ ID NO:164), amplifying a 836 bp PCR product. This PCR product is cloned into pCR4Blunt-TOPO and transformed into E. coli Top10 cells, creating pCR4Blunt-TOPO-Cm. After sequencing to confirm that no errors are introduced by PCR, the Cm cassette is digested from pCR4Blunt-TOPO-Cm as an 828 bp MluI/SwaI fragment and is gel purified. The IdhL-homology containing integration vector pFP988-IdhL is digested with MluI and SwaI and the 4740 bp vector fragment is gel purified. The Cm cassette fragment is ligated with the pFP988-IdhL vector creating pFP988-DIdhL::Cm.

Finally the budB-ilvD-kivD cassette from pFP988DssPspac-budB-ilvD-kivD, described in Example 20, is modified to replace the amylase promoter with the synthetic P11 promoter. Then, the whole operon is moved into pFP988-DIdhL::Cm. The P11 promoter is built by oligonucleotide annealing with primer P11 F-StuI (SEQ ID NO:165) and P11 R-SpeI (SEQ ID NO:166). The annealed oligonucleotide is gel-purified on a 6% Ultra PAGE gel (Embi Tec, San Diego, Calif.). The plasmid pFP988DssPspac-budB-ilvD-kivD, containing the amylase promoter, is digested with StuI and SpeI and the resulting 10.9 kbp vector fragment is gel-purified. The isolated P11 fragment is ligated with the digested pFP988DsspSac-budB-ilvD-kivD to create pFP988-P11-budB-ilvD-kivD. Plasmid pFP988-P11-budB-ilvD-kivD is then digested with StuI and BamHI and the resulting 5.4 kbp P11-budB-ilvD-kivD fragment is gel-purified. pFP988-DIdhL::Cm is digested with HpaI and BamHI and the 5.5 kbp vector fragment isolated. The budB-ilvD-kivD operon is ligated with the integration vector pFP988-DIdhL::Cm to create pFP988-DIdhL-P11-budB-ilvD-kivD::Cm.

Integration of pFP988-DIdhL-P11-budB-ilvD-kivD::Cm into *L. plantarum* BAA-793 to form *L. plantarum* ΔIdhL1::budB-ilvD-kivD::Cm comprising exogenous budB, ilvD, and kivD genes. Electrocompetent cells of *L. plantarum* are prepared as described by Aukrust, T. W., et al. (In: *Electroporation Protocols for Microorganisms*; Nickoloff, J. A., Ed.; Methods in Molecular Biology, Vol. 47; Humana Press, Inc., Totowa, N.J., 1995, pp 201-208). After electroporation, cells are outgrown in MRSSM medium (MRS medium supplemented with 0.5 M sucrose and 0.1 M MgCl$_2$) as described by Aukrust et al. supra for 2 h at 37° C. without shaking. Electroporated cells are plated for selection on MRS plates containing chloramphenicol (10 µg/mL) and incubated at 37° C. Transformants are initially screened by colony PCR amplification to confirm integration, and initial positive clones are then more rigorously screened by PCR amplification with a battery of primers.

Plasmid Expression of ilvC and bdhB genes. The remaining two isobutanol genes are expressed from plasmid pTRKH3 (O'Sullivan D J and Klaenhammer T R, *Gene* 137: 227-231 (1993)) under the control of the *L. plantarum* IdhL promoter (Ferain et al., *J. Bacteriol.* 176:596-601 (1994)). The IdhL promoter is PCR amplified from the genome of *L. plantarum* ATCC BAA-793 using primers PIdhL F-HindIII (SEQ ID NO:167) and PIdhL R-BamHI (SEQ ID NO:168). The 411 bp PCR product is cloned into pCR4Blunt-TOPO and sequenced. The resulting plasmid, pCR4Blunt-TOPO-PIdhL is digested with HindIII and BamHI releasing the PIdhL fragment.

Plasmid pTRKH3 is digested with HindIII and SphI and the gel-purified vector fragment is ligated with the PIdhL fragment and the gel-purified 2.4 kbp BamHI/SphI fragment containing ilvC(B.s.)-bdhB from the *Bacillus* expression plasmid pBDPgroE-ilvC(B.s.)-bdhB (Example 20) in a three-way ligation. The ligation mixture is transformed into *E. coli* Top 10 cells and transformants are grown on Brain Heart Infusion (BHI, Difco Laboratories, Detroit, Mich.) plates containing erythromycin (150 mg/L). Transformants are screened by PCR to confirm construction. The resulting expression plasmid, pTRKH3-ilvC(B.s.)-bdhB is transformed into *L. plantarum* ΔIdhL1::budB-ilvD-kivD::Cm by electroporation, as described above.

*L. plantarum* ΔIdhL1::budB-ilvD-kivD::Cm containing pTRKH3-ilvC(B.s.)-bdhB is inoculated into a 250 mL shake flask containing 50 mL of MRS medium plus erythromycin (10 µg/mL) and grown at 37° C. for 18 to 24 h without shaking, after which isobutanol is detected by HPLC or GC analysis, as described in the General Methods section.

Example 22

Prophetic

Expression of an Isobutanol Biosynthetic Pathway in *Enterococcus Faecalis*

The purpose of this prophetic Example is to describe how to express an isobutanol biosynthetic pathway in *Enterococcus faecalis*. The complete genome sequence of *Enterococcus faecalis* strain V583, which is used as the host strain for the expression of the isobutanol biosynthetic pathway in this Example, has been published (Paulsen et al., *Science* 299: 2071-2074 (2003)). An *E. coli*/Gram-positive shuttle vector, Plasmid pTRKH3 (O'Sullivan D J and Klaenhammer T R, *Gene* 137:227-231 (1993)), is used for expression of the five genes (budB, ilvC, ilvD, kivD, bdhB) of the isobutanol pathway in one operon. pTRKH3 contains an *E. coli* plasmid p15A replication origin, the pAMβ1 replicon, and two antibiotic resistance selection markers for tetracycline and erythromycin. Tetracycline resistance is only expressed in *E. coli*, and erythromycin resistance is expressed in both *E. coli* and Gram-positive bacteria. Plasmid pAMβ1 derivatives can replicate in *E. faecalis* (Poyart et al., *FEMS Microbiol. Lett.* 156:193-198 (1997)). The inducible nisA promoter (PnisA), which has been used for efficient control of gene expression by nisin in a variety of Gram-positive bacteria including *Enterococcus faecalis* (Eichenbaum et al., *Appl. Environ. Microbiol.* 64:2763-2769 (1998)), is used to control expression of the five desired genes encoding the enzymes of the isobutanol biosynthetic pathway.

The plasmid pTrc99A::budB-ilvC-ilvD-kivD (described in Example 14), which contains the isobutanol pathway operon, is modified to replace the *E. coli* ilvC gene (SEQ ID NO:3) with the *B. subtilis* ilvC gene (SEQ ID NO:184). Additionally, the bdhB gene(SEQ ID NO:158) from *Clostridium acetobutylicum* is added to the end of the operon. First, the bdhB gene from pBDPgroE-ilvC(B.s.)-bdhB (described in Example 20) is amplified using primers F-bdhB-AvrII (SEQ ID NO:169) and R-bdhB-BamHI (SEQ ID NO:170), and then TOPO cloned and sequenced. The 1194 bp bdhB fragment is isolated by digestion with AvrII and BamHI, followed by gel purification. This bdhB fragment is ligated with pTrc99A::budB-ilvC-ilvD-kivD that has previously been digested with AvrII and BamHI and the resulting fragment is gel purified. The ligation mixture is transformed into *E. coli* Top10 cells by electroporation and transformants are selected following overnight growth at 37° C. on LB agar plates containing ampicillin (100 µg/mL). The transformants are then screened by colony PCR to confirm the correct clone containing pTrc99A::budB-ilvC-ilvD-kivD-bdhB.

Next, ilvC(B.s.) is amplified from pBDPgroE-ilvC(B.s.)-bdhB (described in Example 20) using primers F-ilvC(B.s.)-AflII (SEQ ID NO:171) and R-ilvC(B.s.)-NotI (SEQ ID NO:172). The PCR product is TOPO cloned and sequenced. The 1051 bp ilvC(B.s.) fragment is isolated by digestion with AflII and NotI followed by gel purification. This fragment is ligated with pTrc99A::budB-ilvC-ilvD-kivD-bdhB that has been cut with AflII and NotI to release the *E. coli* ilvC (the 10.7 kbp vector band is gel purified prior to ligation with ilvC(B.s.)). The ligation mixture is transformed into *E. coli* Top10 cells by electroporation and transformants are selected following overnight growth at 37° C. on LB agar plates containing ampicillin (100 µg/mL). The transformants are then screened by colony PCR to confirm the correct clone containing pTrc99A::budB-ilvC(B.s.)-ilvD-kivD-bdhB.

To provide a promoter for the *E. coli*/Gram-positive shuttle vector pTRKH3, the nisA promoter (Chandrapati et al., *Mol. Microbiol.* 46(2):467-477 (2002)) is PCR-amplified from *Lactococcus lactis* genomic DNA with primers F-PnisA(HindIII) (SEQ ID NO:173) and R-PnisA(SpeI BamHI) (SEQ ID NO:174) and then TOPO cloned. After sequencing, the 213 bp nisA promoter fragment is isolated by digestion with HindIII and BamHI followed by gel purification. Plasmid pTRKH3 is digested with HindIII and BamHI and the vector fragment is gel-purified. The linearized pTRKH3 is ligated with the PnisA fragment and transformed into *E. coli* Top10 cells by electroporation. Transformants are selected following overnight growth at 37° C. on LB agar plates containing erythromycin (25 µg/mL). The transformants are then screened by colony PCR to confirm the correct clone of pTRKH3-PnisA.

Plasmid pTRKH3-PnisA is digested with SpeI and BamHI, and the vector is gel-purified. Plasmid pTrc99A::budB-ilvC(B.s)-ilvD-kivD-bdhB, described above, is digested with SpeI and BamHI, and the 7.5 kbp fragment is gel-purified. The 7.5 kbp budB-ilvC(B.s)-ilvD-kivD-bdhB fragment is ligated into the pTRKH3-PnisA vector at the SpeI and BamHI sites. The ligation mixture is transformed into *E. coli* Top10 cells by electroporation and transformants are selected following overnight growth on LB agar plates containing erythromycin (25 µg/mL) at 37° C. The transformants are then screened by colony PCR. The resulting plasmid is named pTRKH3-PnisA-budB-ilvC(B.s)-ilvD-kivD-bdhB. This plasmid is prepared from the *E. coli* transformants and transformed into electro-competent *E. faecalis* V583 cells by electroporation using methods known in the art (Aukrust, T. W., et al. In: *Electroporation Protocols for Microorganisms*; Nickoloff, J. A., Ed.; *Methods in Molecular Biology*, Vol. 47; Humana Press, Inc., Totowa, N.J., 1995, pp 217-226), resulting in *E. faecalis* V583/pTRKH3-PnisA-budB-ilvC(B.s)-ilvD-kivD-bdhB.

The second plasmid containing nisA regulatory genes, nisR and nisK, the add9 spectinomycin resistance gene, and the pSH71 origin of replication is transformed into *E. faecalis* V583/pTRKH3-PnisA-budB-ilvC(B.s)-ilvD-kivD-bdhB by electroporation. The plasmid containing pSH71 origin of replication is compatible with pAMβ1 derivatives in *E. faecalis* (Eichenbaum et al., supra). Double drug resistant transformants are selected on LB agar plates containing erythromycin (25 µg/mL) and spectinomycin (100 µg/mL), grown at 37° C.

The resulting *E. faecalis* strain V5838 harboring two plasmids, i.e., an expression plasmid (pTRKH3-PnisA-budB-ilvC(B.s)-ilvD-kivD-bdhB) and a regulatory plasmid (pSH71-nisRK), is inoculated into a 250 mL shake flask containing 50 mL of Todd-Hewitt broth supplemented with yeast extract (0.2%) (Fischetti et al., *J. Exp. Med.* 161:1384-1401 (1985)), nisin (20 µg/mL) (Eichenbaum et al., supra), erythromycin (25 µg/mL), and spectinomycin (100 µg/mL). The flask is incubated without shaking at 37° C. for 18-24 h, after which time, isobutanol production is measured by HPLC or GC analysis, as described in the General Methods section.

Example 23

Pyruvate Decarboxylase and Hexokinase Gene Inactivation

This example describes insertion-inactivation of endogenous PDC1, PDC5, and PDC6 genes of *S. cerevisiae*. PDC1, PDC5, and PDC6 genes encode the three major isozymes of pyruvate decarboxylase.

Construction of pdc6::$P_{GPM1}$-sadB Integration Cassette and PDC6 Deletion:

A pdc6::$P_{GPM1}$-sadB-ADH1t-URA3r integration cassette was made by joining the GPM-sadB-ADHt segment (SEQ ID NO:321) from pRS425::GPM-sadB (SEQ ID NO: 322) to the URA3r gene from pUC19-URA3r. pUC19-URA3r (SEQ ID NO: 323) contains the URA3 marker from pRS426 (ATCC #77107) flanked by 75 bp homologous repeat sequences to allow homologous recombination in vivo and removal of the URA3 marker. The two DNA segments were joined by SOE PCR (as described by Horton et al. (1989) Gene 77:61-68) using as template pRS425::GPM-sadB and pUC19-URA3r plasmid DNAs, with Phusion DNA polymerase (New England Biolabs Inc., Beverly, Mass.; catalog no. F-5405) and primers 114117-11A through 114117-11D (SEQ ID NOs: 324, 325, 326, and 327), and 114117-13A and 114117-13B (SEQ ID NOs: 328 and 329).

The outer primers for the SOE PCR (114117-13A and 114117-13B) contained 5' and 3' ~50 bp regions homologous to regions upstream and downstream of the PDC6 promoter and terminator, respectively. The completed cassette PCR fragment was transformed into BY4700 (ATCC #200866) and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 112590-34G and 112590-34H (SEQ ID NOs: 330 and 331), and 112590-34F and 112590-49E (SEQ ID NOs: 332 and 333) to verify integration at the PDC6 locus with deletion of the PDC6 coding region. The URA3r marker was recycled by plating on synthetic complete media supplemented with 2% glucose and 5-FOA at 30° C. following standard protocols. Marker removal was confirmed by patching colonies from the 5-FOA plates onto SD -URA media to verify the absence of growth. The resulting identified strain has the genotype: BY4700 pdc6::$P_{GPM1}$-sadB-ADH1t.

Construction of pdc1::$P_{PDC1}$-ilvD Integration Cassette and PDC1 Deletion:

A pdc1::$P_{PDC1}$-ilvD-FBA1t-URA3r integration cassette was made by joining the ilvD-FBA1t segment (SEQ ID NO:334) from pLH468 (SEQ ID NO: 368) to the URA3r gene from pUC19-URA3r by SOE PCR (as described by Horton et al. (1989) Gene 77:61-68) using as template pLH468 and pUC19-URA3r plasmid DNAs, with Phusion DNA polymerase (New England Biolabs Inc., Beverly, Mass.; catalog no. F-5405) and primers 114117-27A through 114117-27D (SEQ ID NOs: 335, 336, 337, and 338).

The outer primers for the SOE PCR (114117-27A and 114117-27D) contained 5' and 3' ~50 bp regions homologous to regions downstream of the PDC1 promoter and downstream of the PDC1 coding sequence. The completed cassette PCR fragment was transformed into BY4700 pdc6::$P_{GPM1}$-sadB-ADH1t and transformants were maintained on synthetic complete media lacking uracil and supplemented with 2% glucose at 30° C. using standard genetic techniques (*Methods in Yeast Genetics*, 2005, Cold Spring Harbor Laboratory Press, Cold Spring Harbor, N.Y., pp. 201-202). Transformants were screened by PCR using primers 114117-36D and 135 (SEQ ID NOs 339 and 340), and primers 112590-49E and 112590-30F (SEQ ID NOs 333 and 341) to verify integration at the PDC1 locus with deletion of the PDC1 coding sequence. The URA3r marker was recycled by plating on synthetic complete media supplemented with 2% glucose and 5-FOA at 30° C. following standard protocols. Marker removal was confirmed by patching colonies from the 5-FOA plates onto SD -URA media to verify the absence of growth. The resulting identified strain "NYLA67" has the genotype: BY4700 pdc6::P$_{GPM1}$-sadB-ADH1t pdc1::P$_{PDC1}$-ilvD-FBA1t.

HIS3 Deletion

To delete the endogenous HIS3 coding region, a his3::URA3r2 cassette was PCR-amplified from URA3r2 template DNA (SEQ ID NO:342). URA3r2 contains the URA3 marker from pRS426 (ATCC #77107) flanked by 500 bp homologous repeat sequences to allow homologous recombination in vivo and removal of the URA3 marker. PCR was done using Phusion DNA polymerase and primers 114117-45A and 114117-45B (SEQ ID NOs: 343 and 344) which generated a ~2.3 kb PCR product. The HIS3 portion of each primer was derived from the 5' region upstream of the HIS3 promoter and 3' region downstream of the coding region such that integration of the URA3r2 marker results in replacement of the HIS3 coding region. The PCR product was transformed into NYLA67 using standard genetic techniques (*Methods in Yeast Genetics*, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened to verify correct integration by replica plating of transformants onto synthetic complete media lacking histidine and supplemented with 2% glucose at 30° C. The URA3r marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth. The resulting identified strain, called NYLA73, has the genotype: BY4700 pdc6::P$_{GPM1}$-sadB-ADH1t pdc1::P$_{PDC1}$-ilvD-FBA1t Δhis3.

Construction of pdc5::kanMX Integration Cassette and PDC5 Deletion:

A pdc5::kanMX4 cassette was PCR-amplified from strain YLR134W chromosomal DNA (ATCC No. 4034091) using Phusion DNA polymerase and primers PDC5::KanMXF and PDC5::KanMXR (SEQ ID NOs: 345 and 346) which generated a ~2.2 kb PCR product. The PDC5 portion of each primer was derived from the 5' region upstream of the PDC5 promoter and 3' region downstream of the coding region such that integration of the kanMX4 marker results in replacement of the PDC5 coding region. The PCR product was transformed into NYLA73 using standard genetic techniques (*Methods in Yeast Genetics*, 2005, Cold Spring Harbor Laboratory Press, Cold Spring Harbor, N.Y., pp. 201-202) and transformants were selected on YP media supplemented with 1% ethanol and geneticin (200 μg/ml) at 30° C. Transformants were screened by PCR to verify correct integration at the PDC locus with replacement of the PDC5 coding region using primers PDC5kofor and N175 (SEQ ID NOs: 347 and 348). The identified correct transformants have the genotype: BY4700 pdc6::P$_{GPM1}$-sadB-ADH1t pdc1::P$_{PDC1}$-ilvD-FBA1t Δhis3 pdc5::kanMX4. The strain was named NYLA74.

Deletion of HXK2 (Hexokinase II):

A hxk2::URA3r cassette was PCR-amplified from URA3r2 template (described above) using Phusion DNA polymerase and primers 384 and 385 (SEQ ID NOs: 349 and 350) which generated a ~2.3 kb PCR product. The HXK2 portion of each primer was derived from the 5' region upstream of the HXK2 promoter and 3' region downstream of the coding region such that integration of the URA3r2 marker results in replacement of the HXK2 coding region. The PCR product was transformed into NYLA73 using standard genetic techniques (*Methods in Yeast Genetics*, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the HXK2 locus with replacement of the HXK2 coding region using primers N869 and N871 (SEQ ID NOs:351 and 352). The URA3r2 marker was recycled by plating on synthetic complete media supplemented with 2% glucose and 5-FOA at 30° C. following standard protocols. Marker removal was confirmed by patching colonies from the 5-FOA plates onto SD-URA media to verify the absence of growth, and by PCR to verify correct marker removal using primers N946 and N947 (SEQ ID NOs:354 and 355). The resulting identified strain named NYLA83 has the genotype: BY4700 pdc6::P$_{GPM1}$-sadB-ADH1t pdc1::P$_{PDC1}$-ilvD-FBA1t Δhis3 Δhxk2.

Example 24

Construction of a Strain Comprising Hxk2 Deletion and an Isobutanol Biosynthetic Pathway Construction of NYLA93

Described below is insertion-inactivation of endogenous GPD2 and PDC5 genes of *S. cerevisiae*. The resulting PDC inactivation strain was used as a host for expression vectors pYZ067 (SEQ ID NO: 366) and pYZ090 (SEQ ID NO: 367), described in U.S. patent application Ser. No. 12/893,077, filed Sep. 29, 2010, herein incorporated by reference.

Deletion of NAD-dependent glycerol 3-phosphate dehydrogenase: A gpd2::loxP-URA3-loxP cassette was PCR-amplified from pUC19::loxP-URA3-loxP plasmid template using Phusion DNA polymerase and primers LA512 and LA513 (SEQ ID NOs: 210 and 211) which generated a ~1.6 kb PCR product. pUC19::loxP-URA3-loxP (SEQ ID NO: 212) contains the URA3 marker from (ATCC #77107) flanked by loxP recombinase sites. The GPD2 portion of each primer was derived from the 5' region upstream of the GPD2 promoter and 3' region downstream of the coding region such that integration of the loxP-URA3-loxP marker results in replacement of the GPD2 coding region. The PCR product was transformed into NYLA83 using standard genetic techniques (Methods in Yeast Genetics, 2005, Cold Spring Harbor Laboratory Press, Cold Spring Harbor, N.Y., pp. 201-202) and transformants were selected on synthetic complete media lacking uracil and supplemented with 2% glucose at 30° C. Transformants were screened by PCR to verify correct integration at the GPD2 locus with replacement of the HXK2 coding region using primers LA516 and N175 (SEQ ID NO: 214 and 177). The URA3 marker is recycled by transformation with pRS423::PGAL1-cre (SEQ ID NO: 213) and plating on synthetic complete media lacking histidine supplemented with 2% glucose at 30° C. Colonies are patched onto YP (1% galactose) plates at 30° C. to induce URA3 marker excision and are transferred onto YPD plates at 30° C. for recovery. Removal of the URA3 marker is confirmed by patching colonies from the YPD plates onto synthetic complete media lacking uracil to verify the absence of growth. The identified correct clones have the genotype: BY4700 pdc6::P$_{GPM1}$-sadB-ADH1t pdc1::P$_{PDC1}$-ilvD-FBA1t Δhis3 Δhxk2 Δgpd2::loxP. The strain was named NYLA92.

Construction of pdc5::loxP-kanMX-loxP integration cassette and PDC5 deletion:

A pdc5::loxP-kanMX-loxP cassette was PCR-amplified from plasmid pUC19::loxP-kanMX-loxP (SEQ ID NO: 217) using Phusion DNA polymerase and primers LA249 and LA397 (SEQ ID NOs: 218 and 219) which generated a ~2.2 kb PCR product. pUC19::loxP-kanMX-loxP (SEQ ID NO: 217) contains the kanMX gene from pFA6 (Wach, A., et al. (1994). New heterologous modules for classical or PCR-based gene disruptions in *Saccharomyces cerevisiae*, Yeast 10, 1793-1808) and *K. lactis* TEF1 promoter and terminator flanked by loxP recombinase sites. The PDC5 portion of each primer was derived from the 5' region upstream of the PDC5 promoter and 3' region downstream of the coding region such that integration of the loxP-kanMX-loxP marker results in replacement of the PDC5 coding region. The PCR product was transformed into NYLA92 using standard genetic techniques (Methods in Yeast Genetics, 2005, Cold Spring Harbor Laboratory Press, Cold Spring Harbor, N.Y., pp. 201-202) and transformants were selected on YP media supplemented with 1% ethanol and geneticin (200 μg/ml) at 30° C. Transformants were screened by PCR to verify correct integration at the PDC5 locus with replacement of the PDC5 coding region using primers LA363 and LA364 (SEQ ID NOs: 215 and 216). The identified correct transformants have the genotype: BY4700 pdc6::$P_{GPM1}$-sadB-ADH1t pdc1::$P_{PDC1}$-ilvD-FBA1t Δhis3 Δhxk2 Δgpd2::loxP Δpdc5:loxP-kanMX-loxP. The strain was named NYLA93.

pYZ090 and pYZ067 pYZ090 (SEQ ID NO: 221) was constructed to contain a chimeric gene having the coding region of the alsS gene from *Bacillus subtilis* (nt position 457-2172) expressed from the yeast CUP1 promoter (nt 2-449) and followed by the CYC1 terminator (nt 2181-2430) for expression of ALS, and a chimeric gene having the coding region of the ilvC gene from *Lactococcus lactis* (nt 3634-4656) expressed from the yeast ILV5 promoter (2433-3626) and followed by the ILV5 terminator (nt 4682-5304) for expression of KARI.

pYZ067 (SEQ ID NO: 220) was constructed to contain the following chimeric genes: 1) the coding region of the ilvD gene from *S. mutans* UA159 with a C-terminal Lumio tag (nt position 2260-3996) expressed from the yeast FBA1 promoter (nt 1161-2250) followed by the FBA1 terminator (nt 4005-4317) for expression of dihydroxy acid dehydratase (DHAD), 2) the coding region for horse liver ADH (nt 4680-5807) expressed from the yeast GPM1 promoter (nt 5819-6575) followed by the ADH1 terminator (nt 4356-4671) for expression of alcohol dehydrogenase, and 3) the coding region of the KivD gene from *Lactococcus lactis* (nt 7175-8821) expressed from the yeast TDH3 promoter (nt 8830-9493) followed by the TDH3 terminator (nt 6582-7161) for expression of ketoisovalerate decarboxylase.

NYLA93 (pYZ067/pYZ090)

Plasmid vectors pYZ067 and pYZ090 were simultaneously transformed into strain NYLA93 (BY4700 pdc6::$P_{GPM1}$-sadB-ADH1t pdc1::$P_{PDC1}$-ilvD-FBA1t Δhis3 Δhxk2 Δgpd2::loxP Δpdc5:loxP-kanMX-loxP) using standard genetic techniques (*Methods in Yeast Genetics,* 2005, Cold Spring Harbor Laboratory Press, Cold Spring Harbor, N.Y.) and the resulting strain was maintained on synthetic complete media lacking histidine and uracil, and supplemented with 1% ethanol at 30° C.

SEQUENCE LISTING (368 sequences)

SEQ ID NO: 1 - DNA, 1680 bp, K. pneumoniae
atggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaa

SEQ ID NO: 2 - protein, 559 aa, K. pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 3 - DNA, 1476 bp, E. coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 4 - protein, 491 aa, E. coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 5 - DNA, 1851 bp, E. coli
atgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactttccgatcagatcatcaagctcgatctggttgatgcgatgatccagggcgcagacccgaaagtatctgactcccagagcgatcaggttgaacgttccgcgtgtccgacctgcggttcctgctccgggatgtttaccgctaactcaatgaactgcctgaccgaagcgctgggcctgtcgcagccgggcaacggctcgctgctggcaacccacgccgaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctttcccgcaaggttccacagctgtgtaaagttgcgccgagcacccagaaataccatatggaagatgttcaccgtgctggtggtgttatcggtattctcggcgaactggatcgcgcggggttactgaaccgtgatgtgaaaaacgtacttggcctgacgttgccgcaaacgctggaacaatacgacgttatgctgacccaggatgacgcggtaaaaaatatgttccgcgcaggtcctgcaggcattcgtaccacacaggcattctcgcaagattgccgttgggatacgctggacgacgatcgcgccaatggctgtatccgctcgctggaacacgcctacagcaaagacggcggcctggcggtgctctacggtaactttgcggaaaacggctgcatcgtgaaaacggcaggcgtcgatgacagcatcctcaaattcaccggcccggcgaaagtgtacgaaagccaggacgatgcggtagaagcgattctcggcggtaaagttgtcgccggagatgtggtagtaattcgctatgaaggcccgaaaggcggtccggggatgcaggaaatgctctacccaaccagcttcctgaaatcaatgggtctcggcaaagcctgtgcgctgatcaccgacggtcgtttctctggtggcacctctggtctttccatcggccacgtctcaccggaagcggcaagcggcggcagcattggcctgattgaagatggtgacctgatcgctatcgacatcccgaaccgtggcattcagttacaggtaagcgatgccgaactggcggcgcgtcgtgaagcgcaggacgctcgaggtgacaaagcctggacgccgaaaaatcgtgaacgtcaggtctcctttgccctgcgtgcttatgccagcctggcaaccagcgccgacaaaggcgcggtgcgcgataaatcgaaactggggggttaa

SEQ ID NO: 6 - protein, 616 aa, E. coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 7 - DNA, 1662 bp, Lactococcus lactis
tctagacatatgtatactgtgggggattacctgctggatcgcctgcacgaactggggattgaagaaattttcggtgtgccaggcgattataacctgcagttcctggaccagattatctcgcacaaagatatgaagtgggtcggtaacgccaacgaactgaacgcgagctatatggcagatggttatgcccgtaccaaaaaagctgctgcgtttctgacgacctttggcgttggcgaactgagcgccgtcaacggactggcaggaagctacgccgagaacctgccagttgtcgaaattgttgggtcgcctacttctaaggttcagaatgaaggcaaatttgtgcaccatactctggctgatggggattttaaacattttatgaaaatgcatgaaccggttactgcggcccgcacgctgctgacagcagagaatgctacggttgagatcgaccgcgtcctgtctgcgctgctgaaagagcgcaagccggtatatatcaatctgcctgtcgatgttgccgcagcgaaagccgaaaagccgtcgctgccactgaaaaaagaaaacagcacctccaatacatcggaccaggaaattctgaataaaatccaggaatcactgaagaatgcgaagaaaccgatcgtcatcaccggacatgagatcatctcttttggcctggaaaaaacggtcacgcagttcatttctaagaccaaactgcctatcaccaccctgaacttcggcaaatctagcgtcgatgaagcgctgccgagttttctgggtatctataatggtaccctgtccgaaccgaacctgaaagaattcgtcgaaagcgcggactttatcctgatgctgggcgtgaaactgacggatagctccacaggcgcatttacccaccatctgaacgagaataaaatgatttccctgaatatcgacgaaggcaaaatctttaacgagcgcatccagaacttcgattttgaatctctgattagttcgctgctggatctgtccgaaattgagtataaaggtaaatatattgataaaaaacaggaggattttgtgccgtctaatgcgctgctgagtcaggatcgtctgtggcaagccgtagaaaacctgacacagtctaatgaaacgattgttgcggaacagggaacttcatttttcggcgcctcatccatttttctgaaatccaaaagccatttcattggccaaccgctgtgggggagtattggttatacctttccggcggcgctgggttcacagattgcagataaggaatcacgccatctgctgtttattggtgacggcagcctgcagctgactgtccaggaactggggctggcgatccgtgaaaaaatcaatccgatttgctttatcatcaataacgacggctacaccgtcgaacgcgaaattcatggaccgaatcaaagttacaatgacatcccgatgtggaactatagcaaactgccggaatcctttggcgcgacagaggatcgcgtggtgagtaaaattgtgcgtacggaaaacgaatttgtgtcggttatgaaagaagcgcaggctgacccgaatcgcatgtattggattgaactgatcctggcaaaagaaggcgcaccgaaagttctgaaaaagatggggaaactgtttgcggagcaaaataaaagctaaggatcc

SEQ ID NO: 8 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 9 - DNA, 1164 bp, E. coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 10 - protein, 387 aa, E. coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 11 - DNA, 29 bp, Artificial Sequence
  Primer
caccatggacaaacagtatccggtacgcc

SEQ ID NO: 12 - DNA, 25 bp, Artificial Sequence
  Primer
cgaagggcgatagctttaccaatcc

SEQ ID NO: 13 - DNA, 29 bp, Artificial Sequence
  Primer
caccatggctaactacttcaatacactga

SEQ ID NO: 14 - DNA, 28 bp, Artificial Sequence
  Primer
ccaggagaaggccttgagtgttttctcc

SEQ ID NO: 15 - DNA, 29 bp, Artificial Sequence
  Primer
caccatgcctaagtaccgttccgccacca

SEQ ID NO: 16 - DNA, 26 bp, Artificial Sequence
  Primer
cgcagcactgctcttaaatattcggc

SEQ ID NO: 17 - DNA, 29 bp, Artificial Sequence
  Primer
caccatgaacaactttaatctgcacaccc

SEQ ID NO: 18 - DNA, 29 bp, Artificial Sequence
  Primer
caccatgaacaactttaatctgcacaccc

SEQ ID NO: 19 - DNA, 45 bp, Artificial Sequence
  Primer
gcatgccttaagaaaggaggggggtcacatggacaaacagtatcc

SEQ ID NO: 20 - DNA, 39 bp, Artificial Sequence
  Primer
atgcatttaattaattacagaatctgactcagatgcagc

SEQ ID NO: 21 - DNA, 45 bp, Artificial Sequence
  Primer
gtcgacgctagcaaaggagggaatcaccatggctaactacttcaa

SEQ ID NO: 22 - DNA, 31 bp, Artificial Sequence
  Primer
tctagattaacccgcaacagcaatacgtttc

SEQ ID NO: 23 - DNA, 39 bp, Artificial Sequence
  Primer
tctagaaaaggaggaataaagtatgcctaagtaccgttc

SEQ ID NO: 24 - DNA, 31 bp, Artificial Sequence
  Primer
ggatccttattaaccccccagtttcgattta

SEQ ID NO: 25 - DNA, 39 bp, Artificial Sequence
  Primer
ggatccaaaggaggctagacatatgtatactgtggggga

SEQ ID NO: 26 - DNA, 31 bp, Artificial Sequence
  Primer
gagctcttagcttttattttgctccgcaaac

SEQ ID NO: 27 - DNA, 39 bp, Artificial Sequence
  Primer
gagctcaaaggaggagcaagtaatgaacaactttaatct

SEQ ID NO: 28 - DNA, 43 bp, Artificial Sequence
  Primer
gaattcactagtcctaggttagcgggcggcttcgtatatacgg

SEQ ID NO: 29 - DNA, 25 bp, Artificial Sequence
  Primer
caacattagcgattttcttttctct

SEQ ID NO: 30 - DNA, 45 bp, Artificial Sequence
  Primer
catgaagcttactagtgggcttaagttttgaaaataatgaaaact

SEQ ID NO: 31 - DNA, 61 bp, Artificial Sequence
  Primer N110.2
gagctcactagtcaattgtaagtaagtaaaaggaggtgggtcacatggacaaacagtatcc

SEQ ID NO: 32 - DNA, 50 bp, Artificial Sequence
  Primer N111.2
ggatccgatcgacttaagcctcagcttacagaatctgactcagatgcagc

SEQ ID NO: 33 - DNA, 44 bp, Artificial Sequence
  Primer N112.2
gagctccttaagaaggaggtaatcaccatggctaactacttcaa

SEQ ID NO: 34 - DNA, 51 bp, Artificial Sequence
  Primer N113.2
ggatccgatcgagctagcgcggccgcttaacccgcaacagcaatacgtttc

SEQ ID NO: 35 - DNA, 44 bp, Artificial Sequence
  Primer N114.2
gagctcgctagcaaggaggtataaagtatgcctaagtaccgttc

SEQ ID NO: 36 - DNA, 52 bp, Artificial Sequence
  Primer N115.2
ggatccgatcgattaattaacctaaggttattaaccccccagtttcgattta

SEQ ID NO: 37 - DNA, 46 bp, Artificial Sequence
  Primer N116.2
gagctcttaattaaaaggaggttagacatatgtatactgtggggga

SEQ ID NO: 38 - DNA, 49 bp, Artificial Sequence
  Primer 117.2
ggatccagatctcctaggacatgtttagcttttattttgctccgcaaac

SEQ ID NO: 39 - DNA, 3883 bp, Escherichia coli
ctatattgctgaaggtacaggcgtttccataactatttgctcgcgttttttactcaagaagaaaatgccaaatagcaacatcaggcagacaatacccgaaattgcgaagaaaactgtctggtagcctgcgtggtcaaagagtatcccagtcggcgttgaaagcagcacaatcccaagcgaactggcaatttgaaaaccaatcagaaagatcgtcgacgacaggcgcttatcaaagtttgccacgctgtatttgaagacggatatgacacaaagtggaacctcaatggcatgtaacaacttcactaatgaaataatccaggggttaacgaacagcgcgcaggaaaggatacgcaacgccataatcacaactccgataagtaatgcattttttggccctacccgattcacaaagaaaggaataatcgccatgcacagcgcttcgagtaccacctggaatgagttgagataaccatacaggcgcgttcctacatcgtgtgattcgaataaacctgaataaaagacaggaaaaagttgttgatcaaaaatgttatagaaagaccacgtccccacaataaatatgacgaaaacccagaagtttcgatccttgaaaactgcgataaaatcctctttttttacccctcccgcatctgccgctacgcactggtgatccttatctttaaaacgcatgttgatcatcataaatacagcgccaaatagcgagaccaaccagaagttgatatggggactgatactaaaaaatatgccggcaaagaacgcgccaatagcatagccaaaagatccccaggcgcgcgctgttccatattcgaaatgaaaatttcgcgccattttttcggtgaagctatcaagcaaaccgcatcccgccagataccccaagccaaaaaatagcgcccccagaattagacctacagaaaaattgctttgcagtaacggttcataaacgtaaatcataaacggtccggtcaagaccaggatgaaactcatacaccagatgagcggtttcttcagaccgagtttatcctgaacgatgccgtagaacatcataaatagaatgctggtaaactggttgaccgaataaagtgtacctaattccgtccctgtcaaccctagatgtcctttcagccaaatagcgtataacgaccaccacagcgaccaggaaataaaaaagagaaatgagtaactggatgcaaaacgatagtacgcatttctgaatggaatattcagtgccataattacctgcctgtcgttaaaaaattcacgtcctatttagagataagagcgacttcgccgtttacttctcactattccagttcttgtcgacatggcagcgctgtcattgcccctttcgccgttactgcaagcgctccgcaacgttgagcgagatcgataattcgtcgcatttctctctcatctgtagataatcccgtagaggacagacctgtgagtaacccggcaacgaacgcatctcccgcccccgtgctatcgacacaattcacagacattccagcaaaatggtgaacttgtcctcgataacagaccaccaccccttctgcacctttagtcaccaacagcatggcgatctcatactcttttgccagggcgcatatatcctgatcgttctgtgtttttccactgataagtcgccattcttcttccgagagcttgacgacatccgccagttgtagcgcctgccgcaaacacaagcggagcaaatgctcgtcttgccatagatcttcacgaatattaggatcgaagctgacaaaacctccggcatgccggatcgccgtcatcgcagtaaatgcgctggtacgcgaaggctcggcagacaacgcaattgaacagagatgtaaccattcgccatgtcgccagcagggcaagtctgtcgtctctaaaaaaagatcggcactggggcggaccataaacgtaaatgaacgttccccttgatcgttcagatcgacaagcaccgtggatgtccggtgccattcatcttgcttcagatacgtgatatcgactccctcagttagcagcgttctttgcattaacgcaccaaaaggatcatcccccacccgacctataaacccacttgttccgcctaatctggcgattcccaccgcaacgttagctggcgcgccgccaggacaaggcagtaggcgcccgtctgattctggcaagagatctacgaccgcatcccctaaaacccatactttggctgacatttttttcccttaaattcatctgagttacgcatagtgataaacctctttttcgcaaaatcgtcatggatttactaaaacatgcatattcgatcacaaaacgtcatagttaacgttaacatttgtgatattcatcgcatttatgaaagtaagggactttatttttataaaagttaacgttaacaattcaccaaatttgcttaaccaggatgattaaaatgacgcaatctcgattgcatgcggcgcaaaacgccctagcaaaacttcatgagcaccggggtaacactttctatccccattttcacctcgcgcctcctgccgggtggatgaacgatccaaacggcctgatctggtttaacgatcgttatcacgcgttttatcaacatcatccgatgagcgaacactgggggccaatgcactggggacatgccaccagcgacgatatgatccactggcagcatgagcctattgcgctagcgccaggagacgataatgacaaagacgggtgtttttcaggtagtgctgtcgatgacaatggtgtcctctcacttatctacaccggacacgtctggctcgatggtgcaggtaatgacgatgcaattcgcgaagtacaatgtctggctaccagtcgggatggtattcatttcgagaaacagggtgtgatcctcactccaccagaaggaatcatgcacttccgcgatcctaaagtgtggcgtgaagccgacacatggtggatggtagtcggggcgaaagatccaggcaacacggggcagatcctgctttatcgcggcagttcgttgcgtgaatggaccttcgatcgcgtactggcccacgctgatgcgggtgaaagctatatgtgggaatgtccggactttttcagccttggcgatcagcattatctgatgttttccccgcagggaatgaatgccgagggatacagttaccgaaatcgctttcaaagtggcgtaatacccggaatgtggtcgccaggacgactttttgcacaatccgggcattttactgaacttgataacgggcatgacttttatgcaccacaaagctttttagcgaaggatggtcggcgtattgttatcggctggatggatatgtgggaatcgccaatgccctcaaaacgtgaaggatgggcaggctgcatgacgctggcgcgcgagctatcagagagcaatggcaaacttctacaacgcccggtacacgaagctgagtcgttacgccagcagcatcaatctgtctctccccgcacaatcagcaataaatatgttttgcaggaaaacgcgcaagcagttgagattcagttgcagtgggcgctgaagaacagtgatgccgaacattacggattacagctcggcactggaatgcggctgtatattgataaccaatctgagcgacttgttttgtggcggtattacccacacgagaatttagacggctaccgtagtattcccctcccgcagcgtgacacgctcgccctaaggatatttatcgatacatcatccgtggaagtatttattaacgacggggaagcggtgatgagtagtcgaatctatccgcagccagaagaacgggaactgtcgctttatgcctcccacggagtggctgtgctgcaacatggagcactctggctactgggttaa

SEQ ID NO: 40 - DNA, 19 bp, Artificial Sequence
  Primer N130SeqF1
tgttccaacctgatcaccg

SEQ ID NO: 41 - DNA, 18 bp, Artificial Sequence
  Primer N130SeqF2
ggaaaacagcaaggcgct

SEQ ID NO: 42 - DNA, 18 bp, Artificial Sequence
  Primer N130SeqF3
cagctgaaccagtttgcc

SEQ ID NO: 43 - DNA, 19 bp, Artificial Sequence
  Primer N130SeqF4
aaaataccagcgcctgtcc

SEQ ID NO: 44 - DNA, 18 bp, Artificial Sequence
  Primer N130SeqR1
tgaatggccaccatgttg

SEQ ID NO: 45 - DNA, 18 bp, Artificial Sequence
  Primer N130SeqR2
gaggatctccgccgcctg

SEQ ID NO: 46 - DNA, 18 bp, Artificial Sequence
  Primer N130SeqR3
aggccgagcaggaagatc

SEQ ID NO: 47 - DNA, 19 bp, Artificial Sequence
  Primer N130SeqR4
tgatcaggttggaacagcc

SEQ ID NO: 48 - DNA, 19 bp, Artificial Sequence
  Primer N131SeqF1
aagaactgatcccacaggc

SEQ ID NO: 49 - DNA, 19 bp, Artificial Sequence
  Primer N131SeqF2
atcctgtgcggtatgttgc

SEQ ID NO: 50 - DNA, 18 bp, Artificial Sequence
  Primer N131Seqf3
attgcgatggtgaaagcg

SEQ ID NO: 51 - DNA, 19 bp, Artificial Sequence
  Primer N131SeqR1
atggtgttggcaatcagcg

SEQ ID NO: 52 - DNA, 18 bp, Artificial Sequence
  Primer N131SeqR2
gtgcttcggtgatggttt

SEQ ID NO: 53 - DNA, 19 bp, Artificial Sequence
  Primer N131SeqR3
ttgaaaccgtgcgagtagc

SEQ ID NO: 54 - DNA, 19 bp, Artificial Sequence
  Primer N132SeqF1
tattcactgccatctcgcg

SEQ ID NO: 55 - DNA, 18 bp, Artificial Sequence
  Primer N132SeqF2
ccgtaagcagctgttcct

SEQ ID NO: 56 - DNA, 20 bp, Artificial Sequence
  Primer N132SeqF3
gctggaacaatacgacgtta

SEQ ID NO: 57 - DNA, 20 bp, Artificial Sequence
  Primer N132SeqF4
tgctctacccaaccagcttc

SEQ ID NO: 58 - DNA, 20 bp, Artificial Sequence
  Primer N132SeqR1
atggaaagaccagaggtgcc

SEQ ID NO: 59 - DNA, 18 bp, Artificial Sequence
  Primer N132SeqR2
tgcctgtgtggtacgaat

SEQ ID NO: 60 - DNA, 19 bp, Artificial Sequence
  Primer N132SeqR3
tattacgcggcagtgcact

SEQ ID NO: 61 - DNA, 22 bp, Artificial Sequence
  Primer N132SeqR4
ggtgattttgtcgcagttagag

SEQ ID NO: 62 - DNA, 18 bp, Artificial Sequence
  Primer N133SeqF1
tcgaaattgttgggtcgc

SEQ ID NO: 63 - DNA, 22 bp, Artificial Sequence
  Primer N133SeqF2
ggtcacgcagttcatttctaag

SEQ ID NO: 64 - DNA, 18 bp, Artificial Sequence
  Primer N133SeqF3
tgtggcaagccgtagaaa

SEQ ID NO: 65 - DNA, 19 bp, Artificial Sequence
  Primer N133SeqF4
aggatcgcgtggtgagtaa

SEQ ID NO: 66 - DNA, 20 bp, Artificial Sequence
  Primer N133SeqR1
gtagccgtcgttattgatga

SEQ ID NO: 67 - DNA, 22 bp, Artificial Sequence
  Primer N133SeqR2
gcagcgaactaatcagagattc

SEQ ID NO: 68 - DNA, 19 bp, Artificial Sequence
  Primer N133SeqR3
tggtccgatgtattggagg

SEQ ID NO: 69 - DNA, 19 bp, Artificial Sequence
  Primer N133SeqR4
tctgccatatagctcgcgt

SEQ ID NO: 70 - DNA, 42 bp, Artificial Sequence
  Promoter 1.6GI Variant
gcccttgacaatgccacatcctgagcaaataattcaaccact

SEQ ID NO: 71 - DNA, 42 bp, Artificial Sequence
  Promoter 1.5GI
gcccttgactatgccacatcctgagcaaataattcaaccact

SEQ ID NO: 72 - DNA, 18 bp, Artificial Sequence
  Primer Scr1
cctttctttgtgaatcgg

SEQ ID NO: 73 - DNA, 18 bp, Artificial Sequence
  Primer Scr2
agaaacagggtgtgatcc

SEQ ID NO: 74 - DNA, 20 bp, Artificial Sequence
  Primer Scr3
agtgatcatcacctgttgcc

SEQ ID NO: 75 - DNA, 20 bp, Artificial Sequence
  Primer Scr4
agcacggcgagagtcgacgg

SEQ ID NO: 76 - DNA, 672 bp, Saccharomyces cerevisiae
agttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaac

SEQ ID NO: 77 - DNA, 270 bp, Saccharomyces cerevisiae
gacctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaa

SEQ ID NO: 78 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 79 - DNA, 643 bp, Saccharomyces cerevisiae
gaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctaga

SEQ ID NO: 80 - DNA, 1188 bp, Saccharomyces cerevisiae
atgttgagaactcaagccgccagattgatctgcaactcccgtgtcatcactgctaagagaacctttgctttggccacccgtgctgctgcttacagcagaccagctgcccgtttcgttaagccaatgatcactacccgtggtttgaagcaaatcaacttcggtggtactgttgaaaccgtctacgaaagagctgactggccaagagaaaagttgttggactacttcaagaacgacacttttgctttgatcggttacggttcccaaggttacggtcaaggtttgaacttgagagacaacggtttgaacgttatcattggtgtccgtaaagatggtgcttcttggaaggctgccatcgaagacggttgggttccaggcaagaacttgttcactgttgaagatgctatcaagagaggtagttacgttatgaacttgttgtccgatgccgctcaatcagaaacctggcctgctatcaagccattgttgaccaagggtaagactttgtacttctcccacggtttctccccagtcttcaaggacttgactcacgttgaaccaccaaaggacttagatgttatcttggttgctccaaagggttccggtagaactgtcagatctttgttcaaggaaggtcgtggtattaactcttcttacgccgtctggaacgatgtcaccggtaaggctcacgaaaaggcccaagctttggccgttgccattggttccggttacgtttaccaaaccactttcgaaagagaagtcaactctgacttgtacggtgaaagaggttgtttaatgggtggtatccacggtatgttcttggctcaatacgacgtcttgagagaaaacggtcactccccatctgaagctttcaacgaaaccgtcgaagaagctacccaatctctatacccattgatcggtaagtacggtatggattacatgtacgatgcttgttccaccaccgccagaagaggtgctttggactggtacccaatcttcaagaatgctttgaagcctgttttccaagacttgtacgaatctaccaagaacggtaccgaaaccaagagatctttggaattcaactctcaacctgactacagagaaaagctagaaaaggaattagacaccatcagaaacatggaaatctggaaggttggtaaggaagtcagaaagttgagaccagaaaaccaataa

SEQ ID NO: 81 - DNA, 760 bp, Saccharomyces cerevisiae
tcttttccgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcatatacaatg

SEQ ID NO: 82 - DNA, 316 bp, Saccharomyces cerevisiae
gagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 83 - DNA, 1758 bp, Saccharomyces cerevisiae
atgggcttgttaacgaaagttgctacatctagacaattctctacaacgagatgcgttgcaaagaagctcaacaagtactcgtatatcatcactgaacctaagggccaaggtgcgtcccaggccatgctttatgccaccggtttcaagaaggaagatttcaagaagcctcaagtcggggttggttcctgttggtggtccggtaacccatgtaacatgcatctattggacttgaataacagatgttctcaatccattgaaaaagcgggtttgaaagctatgcagttcaacaccatcggtgtttcagacggtatctctatgggtactaaaggtatgagatactcgttacaaagtagagaaatcattgcagactcctttgaaaccatcatgatggcacaacactacgatgctaacatcgccatcccatcatgtgacaaaaacatgcccggtgtcatgatggccatgggtagacataacagaccttccatcatggtatatggtggtactatcttgcccggtcatccaacatgtggttcttcgaagatctctaaaaacatcgatatcgtctctgcgttccaatcctacggtgaatatatttccaagcaattcactgaagaagaaagagaagatgttgtggaacatgcatgcccaggtcctggttcttgtggtggtatgtatactgccaacacaatggcttctgccgctgaagtgctaggtttgaccattccaaactcctcttccttcccagccgtttccaaggagaagttagctgagtgtgacaacattggtgaatacatcaagaagacaatggaattgggtattttacctcgtgatatcctcacaaaagaggcttttgaaaacgccattacttatgtcgttgcaaccggtgggtccactaatgctgttttgcatttggtggctgttgctcactctgcgggtgtcaagttgtcaccagatgatttccaaagaatcagtgatactacaccattgatcggtgacttcaaaccttctggtaaatacgtcatggccgatttgattaacgttggtggtacccaatctgtgattaagtatctatatgaaaacaacatgttgcacggtaacacaatgactgttaccggtgacactttggcagaacgtgcaaagaaagcaccaagcctacctgaaggacaagagattattaagccactctcccacccaatcaaggccaacggtcacttgcaaattctgtacggttcattggcaccaggtggagctgtgggtaaaattaccggtaaggaaggtacttacttcaagggtagagcacgtgtgttcgaagaggaaggtgcctttattgaagccttggaaagaggtgaaatcaagaagggtgaaaaaaccgttgttgttatcagatatgaaggtccaagaggtgcaccaggtatgcctgaaatgctaaagccttcctctgctctgatgggttacggtttgggtaaagatgttgcattgttgactgatggtagattctctggtggttctcacgggttcttaatcggccacattgttcccgaagccgctgaaggtggtcctatcgggttggtcagagacggcgatgagattatcattgatgctgataataacaagattgacctattagtctctgataaggaaatggctcaacgtaaacaaagttgggttgcacctccacctcgttacacaagaggtactctatccaagtatgctaagttggtttccaacgcttccaacggttgtgttttagatgcttga

SEQ ID NO: 84 - DNA, 753 bp, Saccharomyces cerevisiae
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaata

SEQ ID NO: 85 - DNA, 20 bp, Artificial Sequence
  Primer N98SeqF1
cgtgttagtcacatcaggac

SEQ ID NO: 86 - DNA, 24 bp, Artificial Sequence
  Primer N98SeqF2
ggccatagcaaaaatccaaacagc

SEQ ID NO: 87 - DNA, 24 bp, Artificial Sequence
  Primer N98SeqF3
ccacgatcaatcatatcgaacacg

SEQ ID NO: 88 - DNA, 20 bp, Artificial Sequence
  Primer N98SeqF4
ggtttctgtctctggtgacg

SEQ ID NO: 89 - DNA, 22 bp, Artificial Sequence
  Primer N99SeqR1
gtctggtgattctacgcgcaag

SEQ ID NO: 90 - DNA, 22 bp, Artificial Sequence
  Primer N99SeqR2
catcgactgcattacgcaactc

SEQ ID NO: 91 - DNA, 22 bp, Artificial Sequence
  Primer N99SeqR3
cgatcgtcagaacaacatctgc

SEQ ID NO: 92 - DNA, 20 bp, Artificial Sequence
  Primer N99SeqR4
ccttcagtgttcgctgtcag

SEQ ID NO: 93 - DNA, 36 bp, Artificial Sequence
  Primer N136
ccgcggatagatctgaaatgaataacaatactgaca

SEQ ID NO: 94 - DNA, 65 bp, Artificial Sequence
  Primer N137
taccaccgaagttgatttgcttcaacatcctcagctctagatttgaatatgtattacttggttat

SEQ ID NO: 95 - DNA, 28 bp, Artificial Sequence
  Primer N138
atgttgaagcaaatcaacttcggtggta

SEQ ID NO: 96 - DNA, 22 bp, Artificial Sequence
  Primer N139
ttattggttttctggtctcaac

SEQ ID NO: 97 - DNA, 57 bp, Artificial Sequence
  Primer N140
aagttgagaccagaaaaccaataattaattaatcatgtaattagttatgtcacgctt

SEQ ID NO: 98 - DNA, 30 bp, Artificial Sequence
  Primer N141
gcggccgcccgcaaattaaagccttcgagc

SEQ ID NO: 99 - DNA, 28 bp, Artificial Sequence
  Primer N142
ggatccgcatgcttgcatttagtcgtgc

SEQ ID NO: 100 - DNA, 56 bp, Artificial Sequence
  N143
caggtaatcccccacagtatacatcctcagctattgtaatatgtgtgtttgtttgg

SEQ ID NO: 101 - DNA, 22 bp, Artificial Sequence
  Primer N144
atgtatactgtgggggattacc

SEQ ID NO: 102 - DNA, 22 bp, Artificial Sequence
  Primer N145
ttagcttttattttgctccgca

SEQ ID NO: 103 - DNA, 57 bp, Artificial Sequence
  Primer N146
tttgcggagcaaaataaaagctaattaattaagagtaagcgaatttcttatgattta

SEQ ID NO: 104 - DNA, 28 bp, Artificial Sequence
  Primer N147
actagtaccacaggtgttgtcctctgag

SEQ ID NO: 105 - DNA, 22 bp, Artificial Sequence
  Primer N151
ctagagagctttcgttttcatg

SEQ ID NO: 106 - DNA, 57 bp, Artificial Sequence
  Primer N152
ctcatgaaaacgaaagctctctagttaattaatcatgtaattagttatgtcacgctt

SEQ ID NO: 107 - DNA, 25 bp, Artificial Sequence
  Primer N155
atggcaaagaagctcaacaagtact

SEQ ID NO: 108 - DNA, 22 bp, Artificial Sequence
  Primer N156
tcaagcatctaaaacacaaccg

SEQ ID NO: 109 - DNA, 57 bp, Artificial Sequence
  Primer N157
aacggttgtgttttagatgcttgattaattaagagtaagcgaatttcttatgattta

SEQ ID NO: 110 - DNA, 28 bp, Artificial Sequence
  Primer N158
ggatccttttctggcaaccaaacccata

SEQ ID NO: 111 - DNA, 56 bp, Artificial Sequence
  Primer N159
cgagtacttgttgagcttctttgccatcctcagcgagatagttgattgtatgcttg

SEQ ID NO: 112 - DNA, 19 bp, Artificial Sequence
  Primer N160SeqF1
gaaaacgtggcatcctctc

SEQ ID NO: 113 - DNA, 19 bp, Artificial Sequence
  Primer N160SeqF2
gctgactggccaagagaaa

SEQ ID NO: 114 - DNA, 20 bp, Artificial Sequence
  Primer N160SeqF3
tgtacttctcccacggtttc

SEQ ID NO: 115 - DNA, 22 bp, Artificial Sequence
  Primer N160SeqF4
agctacccaatctctataccca

SEQ ID NO: 116 - DNA, 22 bp, Artificial Sequence
  Primer N160SeqF5
cctgaagtctaggtccctattt

SEQ ID NO: 117 - DNA, 19 bp, Artificial Sequence
  N160SeqR1
gcgtgaatgtaagcgtgac

SEQ ID NO: 118 - DNA, 20 bp, Artificial Sequence
  Primer N160SeqR2
cgtcgtattgagccaagaac

SEQ ID NO: 119 - DNA, 20 bp, Artificial Sequence
  Primer N160SeqR3
gcatcggacaacaagttcat

SEQ ID NO: 120 - DNA, 22 bp, Artificial Sequence
  Primer N160SeqR4
tcgttcttgaagtagtccaaca

SEQ ID NO: 121 - DNA, 19 bp, Artificial Sequence
  Primer N160SeqR5
tgagcccgaaagagaggat

SEQ ID NO: 122 - DNA, 19 bp, Artificial Sequence
  Primer N161SeqF1
acggtatacggccttcctt

SEQ ID NO: 123 - DNA, 20 bp, Artificial Sequence
  Primer N161SeqF2
gggtttgaaagctatgcagt

SEQ ID NO: 124 - DNA, 22 bp, Artificial Sequence
  Primer N161SeqF3
ggtggtatgtatactgccaaca

SEQ ID NO: 125 - DNA, 22 bp, Artificial Sequence
  Primer N161SeqF4
ggtggtacccaatctgtgatta

SEQ ID NO: 126 - DNA, 20 bp, Artificial Sequence
  Primer N161SeqF5
cggtttgggtaaagatgttg

SEQ ID NO: 127 - DNA, 22 bp, Artificial Sequence
  Primer N161SeqF6
aaacgaaaattcttattcttga

SEQ ID NO: 128 - DNA, 22 bp, Artificial Sequence
  Primer N161SeqR1
tcgttttaaaacctaagagtca

SEQ ID NO: 129 - DNA, 19 bp, Artificial Sequence
  Primer N161SeqR2
ccaaaccgtaacccatcag

SEQ ID NO: 130 - DNA, 19 bp, Artificial Sequence
  Primer N161SeqR3
cacagattgggtaccacca

SEQ ID NO: 131 - DNA, 20 bp, Artificial Sequence
  Primer N161Seqr4
accacaagaaccaggacctg

SEQ ID NO: 132 - DNA, 19 bp, Artificial Sequence
  Primer N161SeqR5
catagctttcaaacccgct

SEQ ID NO: 133 - DNA, 22 bp, Artificial Sequence
  Primer N161SeqR6
cgtataccgttgctcattagag

SEQ ID NO: 134 - DNA, 23 bp, Artificial Sequence
  Primer N162
atgttgacaaaagcaacaaaaga

SEQ ID NO: 135 - DNA, 38 bp, Artificial Sequence
  Primer N189
atccgcggatagatctagttcgagtttatcattatcaa

SEQ ID NO: 136 - DNA, 53 bp, Artificial Sequence
  Primer N190.1
ttcttttgttgcttttgtcaacatcctcagcgtttatgtgtgtttattcgaaa

SEQ ID NO: 137 - DNA, 38 bp, Artificial Sequence
  Primer N176
atccgcggatagatctattagaagccgccgagcgggcg

SEQ ID NO: 138 - DNA, 31 bp, Artificial Sequence
  Primer N177
atcctcagcttttctccttgacgttaaagta

SEQ ID NO: 139 - protein, 477 aa, Escherichia coli
MTQSRLHAAQNALAKLHEHRGNTFYPHFHLAPPAGWMNDPNGLIWFNDRYHAFYQHHPMSEHWGPMHWGHATSDDMIHWQHEPIALAPGDDNDKDGCFSGSAVDDNGVLSLIYTGHVWLDGAGNDDAIREVQCLATSRDGIHFEKQGVILTPPEGIMHFRDPKVWREADTWWMVVGAKDPGNTGQILLYRGSSLREWTFDRVLAHADAGESYMWECPDFFSLGDQHYLMFSPQGMNAEGYSYRNRFQSGVIPGMWSPGRLFAQSGHFTELDNGHDFYAPQSFLAKDGRRIVIGWMDMWESPMPSKREGWAGCMTLARELSESNGKLLQRPVHEAESLRQQHQSVSPRTISNKYVLQENAQAVEIQLQWALKNSDAEHYGLQLGTGMRLYIDNQSERLVLWRYYPHENLDGYRSIPLPQRDTLALRIFIDTSSVEVFINDGEAVMSSRIYPQPEERELSLYASHGVAVLQHGALWLLG

SEQ ID NO: 140 - protein, 304 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDQDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELE

SEQ ID NO: 141 - protein, 415 aa, Escherichia coli
MALNIPFRNAYYRFASSYSFLFFISWSLWWSLYAIWLKGHLGLTGTELGTLYSVNQFTSILFMMFYGIVQDKLGLKKPLIWCMSFILVLTGPFMIYVYEPLLQSNFSVGLILGALFFGLGYLAGCGLLDSFTEKMARNFHFEYGTARAWGSFGYAIGAFFAGIFFSISPHINFWLVSLFGAVFMMINMRFKDKDHQCVAADAGGVKKEDFIAVFKDRNFWVFVIFIVGTWSFYNIFDQQLFPVFYSGLFESHDVGTRLYGYLNSFQVVLEALCMAIIPFFVNRVGPKNALLIGVVIMALRILSCALFVNPWIISLVKLLHAIEVPLCVISVFKYSVANFDKRLSSTIFLIGFQIASSLGIVLLSTPTGILFDHAGYQTVFFAISGIVCLMLLFGIFFLSKKREQIVMETPVPSAI

SEQ ID NO: 142 - DNA, 6341 bp, Artificial Sequence
  Plasmid pFP988DssPspac
gatccaagtttaaactgtacactagatatttcttctccgcttaaatcatcaaagaaatctttatcacttgtaaccagtccgtccacatgtcgaattgcatctgaccgaattttacgtttccctgaataattctcatcaatcgtttcatcaattttatctttatactttatattttgtgcgttaatcaaatcataatttttatatgtttcctcatgatttatgtctttattattatagtttttattctctctttgattatgtctttgtatcccgtttgtattacttgatcctttaactctggcaaccctcaaaattgaatgagacatgctacacctccggataataaatatatataaacgtatatagatttcataaagtctaacacactagacttatttacttcgtaattaagtcgttaaaccgtgtgctctacgaccaaaactataaaacctttaagaactttctttttttacaagaaaaaagaaattagataaatctctcatatcttttattcaataatcgcatccgattgcagtataaatttaacgatcactcatcatgttcatatttatcagagctcgtgctataattatactaattttataaggaggaaaaaatatgggcatttttagtatttttgtaatcagcacagttcattatcaaccaaacaaaaaataagtggttataatgaatcgttaataagcaaaattcatataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtaaagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatatggtaatataccttataacataagtacggatataatacgcaaaattgtttttgatagtatagctaatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaagtagaaaaaaatcaagaatatcacacaaagataaacaaaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttgcatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgctccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttcatgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagaattcgagctctcgagtaattctacacagcccagtccagactattcggcactgaaattatgggtgaagtggtcaagacctcactaggcaccttaaaaatagcgcaccctgaagaagatttatttgaggtagcccttgcctacctagcttccaagaaagatatcctaacagcacaagagcggaaagatgttttgttctacatccagaacaacctctgctaaaattcctgaaaaattttgcaaaaagttgttgactttatctacaaggtgtggcataatgtgtggaattgtgagcgctcacaattaagcttgaattccc

SEQ ID NO: 143 - DNA, 6221 bp, Artificial Sequence
  Plasmid pFP988DssPgroE
tcgagagctattgtaacataatcggtacgggggtgaaaaagctaacggaaaagggagcggaaaagaatgatgtaagcgtgaaaaattttttatcttatcacttgaaattggaagggagattctttattataagaattgtggaattgtgagcggataacaattcccaattaaaggaggaaactagtggatccaagtttaaactgtacactagatatttcttctccgcttaaatcatcaaagaaatctttatcacttgtaaccagtccgtccacatgtcgaattgcatctgaccgaattttacgtttccctgaataattctcatcaatcgtttcatcaattttatctttatactttatattttgtgcgttaatcaaatcataatttttatatgtttcctcatgatttatgtctttattattatagtttttattctctctttgattatgtctttgtatcccgtttgtattacttgatcctttaactctggcaaccctcaaaattgaatgagacatgctacacctccggataataaatatatataaacgtatatagatttcataaagtctaacacactagacttatttacttcgtaattaagtcgttaaaccgtgtgctctacgaccaaaactataaaacctttaagaactttctttttttacaagaaaaaagaaattagataaatctctcatatcttttattcaataatcgcatccgattgcagtataaatttaacgatcactcatcatgttcatatttatcagagctcgtgctataattatactaattttataaggaggaaaaaatatgggcatttttagtatttttgtaatcagcacagttcattatcaaccaaacaaaaaataagtggttataatgaatcgttaataagcaaaattcatataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtaaagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatatggtaatataccttataacataagtacggatataatacgcaaaattgtttttgatagtatagctaatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaagtagaaaaaaatcaagaatatcacacaaagataaacaaaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttgcatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgctccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttcatgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagaattcgagctc

SEQ ID NO: 144 - DNA, 40 bp, Artificial Sequence
  Primer T-budB (BamHI)
agatagatggatccggaggtgggtcacatggacaaacagt

SEQ ID NO: 145 - DNA, 29 bp, Artificial Sequence
  Primer B-kivD (BamHI)
ctctagaggatccagactcctaggacatg

SEQ ID NO: 146 - DNA, 6039 bp, Artificial Sequence
  Vector fragment pFP988Dss
gatccaagtttaaactgtacactagatatttcttctccgcttaaatcatcaaagaaatctttatcacttgtaaccagtccgtccacatgtcgaattgcatctgaccgaattttacgtttccctgaataattctcatcaatcgtttcatcaattttatctttatactttatattttgtgcgttaatcaaatcataatttttatatgtttcctcatgatttatgtctttattattatagtttttattctctctttgattatgtctttgtatcccgtttgtattacttgatcctttaactctggcaaccctcaaaattgaatgagacatgctacacctccggataataaatatatataaacgtatatagatttcataaagtctaacacactagacttatttacttcgtaattaagtcgttaaaccgtgtgctctacgaccaaaactataaaacctttaagaactttctttttttacaagaaaaaagaaattagataaatctctcatatcttttattcaataatcgcatccgattgcagtataaatttaacgatcactcatcatgttcatatttatcagagctcgtgctataattatactaattttataaggaggaaaaaatatgggcatttttagtatttttgtaatcagcacagttcattatcaaccaaacaaaaaataagtggttataatgaatcgttaataagcaaaattcatataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtaaagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatatggtaatataccttataacataagtacggatataatacgcaaaattgtttttgatagtatagctaatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaagtagaaaaaaatcaagaatatcacacaaagataaacaaaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttgcatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgctccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttcatgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagaattcgagctctcga

SEQ ID NO: 147 - DNA, 44 bp, Artificial Sequence
  Primer T-groE(XhoI)
agatagatctcgagagctattgtaacataatcggtacgggggtg

SEQ ID NO: 148 - DNA, 51 bp, Artificial Sequence
  Primer B-groEL (SpeI BamH1)
attatgtcaggatccactagtttcctcctttaattgggaattgttatccgc

SEQ ID NO: 149 - DNA, 30 bp, Artificial Sequence
  Primer T-groEL
agctattgtaacataatcggtacgggggtg

SEQ ID NO: 150 - DNA, 45 bp, Artificial Sequence
  Primer T-ilvCB.s.(BamHI)
acattgatggatcccataacaagggagagattgaaatggtaaaag

SEQ ID NO: 151 - DNA, 47 bp, Artificial Sequence
  Primer B-ilvCB.s.(SpeIBamHI)
tagacaacggatccactagtttaattttgcgcaacggagaccaccgc

SEQ ID NO: 152 - DNA, 47 bp, Artificial Sequence
  Primer T-BD64 (DraIII)
ttaccgtggactcaccgagtgggtaactagcctcgccggaaagagcg

SEQ ID NO: 153 - DNA, 48 bp, Artificial Sequence
  Primer B-BD64 (DraIII)
tcacagttaagacacctggtgccgttaatgcgccatgacagccatgat

SEQ ID NO: 154 - DNA, 49 bp, Artificial Sequence
  Primer T-lacIq (DraIII)
acagatagatcaccaggtgcaagctaattccggtggaaacgaggtcatc

SEQ ID NO: 155 - DNA, 48 bp, Artificial Sequence
  Primer B-lacIq (DraIII)
acagtacgatacacggggtgtcactgcccgctttccagtcgggaaacc

SEQ ID NO: 156 - DNA, 49 bp, Artificial Sequence
  Primer T-groE (DraIII)
tcggattacgcaccccgtgagctattgtaacataatcggtacgggggtg

SEQ ID NO: 157 - DNA, 48 bp, Artificial Sequence
  Primer B-B.s.ilvC (DraIII)
ctgctgatctcacaccgtgtgttaattttgcgcaacggagaccaccgc

SEQ ID NO: 158 - DNA, 1221 bp, Clostridium acetobutylicum
cacacggtgtaaataataatctaaacaggaggggttaaaatggttgatttcgaatattcaataccaactagaatttttttcggtaaagataagataaatgtacttggaagagagcttaaaaaatatggttctaaagtgcttatagtttatggtggaggaagtataaagagaaatggaatatatgataaagctgtaagtatacttgaaaaaaacagtattaaattttatgaacttgcaggagtagagccaaatccaagagtaactacagttgaaaaaggagttaaaatatgtagagaaaatggagttgaagtagtactagctataggtggaggaagtgcaatagattgcgcaaaggttatagcagcagcatgtgaatatgatggaaatccatgggatattgtgttagatggctcaaaaataaaaagggtgcttcctatagctagtatattaaccattgctgcaacaggatcagaaatggatacgtgggcagtaataaataatatggatacaaacgaaaaactaattgcggcacatccagatatggctcctaagttttctatattagatccaacgtatacgtataccgtacctaccaatcaaacagcagcaggaacagctgatattatgagtcatatatttgaggtgtattttagtaatacaaaaacagcatatttgcaggatagaatggcagaagcgttattaagaacttgtattaaatatggaggaatagctcttgagaagccggatgattatgaggcaagagccaatctaatgtgggcttcaagtcttgcgataaatggacttttaacatatggtaaagacactaattggagtgtacacttaatggaacatgaattaagtgcttattacgacataacacacggcgtagggcttgcaattttaacacctaattggatggagtatattttaaataatgatacagtgtacaagtttgttgaatatggtgtaaatgtttggggaatagacaaagaaaaaaatcactatgacatagcacatcaagcaatacaaaaaacaagagattactttgtaaatgtactaggtttaccatctagactgagagatgttggaattgaagaagaaaaattggacataatggcaaaggaatcagtaaagcttacaggaggaaccataggaaacctaagaccagtaaacgcctccgaagtcctacaaatattcaaaaaatctgtgtaacaccgagtg

SEQ ID NO: 159 - DNA, 54 bp, Artificial Sequence
  Primer T-bdhB (DraIII)
tcgatagcatacacacggtggttaacaaaggaggggttaaaatggttgatttcg

SEQ ID NO: 160 - DNA, 91 bp, Artificial Sequence
  Primer B-bdhB (rrnBT1DraIII)
atctacgcactcggtgataaaacgaaaggcccagtctttcgactgagcctttcgttttatcttacacagattttttgaatatttgtaggac

SEQ ID NO: 161 - DNA, 29 bp, Artificial Sequence
  Primer LDH EcoRV F
gacgtcatgaccacccgccgatccctttt

SEQ ID NO: 162 - DNA, 30 bp, Artificial Sequence
  Primer LDH AatIIR
gatatccaacaccagcgaccgacgtattac

SEQ ID NO: 163 - DNA, 47 bp, Artificial Sequence
  Primer Cm F
atttaaatctcgagtagaggatcccaacaaacgaaaattggataaag

SEQ ID NO: 164 - DNA, 29 bp, Artificial Sequence
  Primer Cm R
acgcgttattataaaagccagtcattagg

SEQ ID NO: 165 - DNA, 58 bp, Artificial Sequence
  Primer P11 F-StuI
cctagcgctatagttgttgacagaatggacatactatgatatattgttgctatagcga

SEQ ID NO: 166 - DNA, 62 bp, Artificial Sequence
  Primer P11 R-SpeI
ctagtcgctatagcaacaatatatcatagtatgtccattctgtcaacaactatagcgctagg

SEQ ID NO: 167 - DNA, 38 bp, Artificial Sequence
  Primer PldhL F-HindIII
aagcttgtcgacaaaccaacattatgacgtgtctgggc

SEQ ID NO: 168 - DNA, 28 bp, Artificial Sequence
  Primer PldhL R-BamHI
ggatcctcatcctctcgtagtgaaaatt

SEQ ID NO: 169 - DNA, 36 bp, Artificial Sequence
  Primer F-bdhB-AvrII
ttcctaggaaggaggtggttaaaatggttgatttcg

SEQ ID NO: 170 - DNA, 29 bp, Artificial Sequence
  Primer R-bdhB-BamHI
ttggatccttacacagattttttgaatat

SEQ ID NO: 171 - DNA, 39 bp, Artificial Sequence
  Primer F-ilvC(B.s.)-AflII
aacttaagaaggaggtgattgaaatggtaaaagtatatt

SEQ ID NO: 172 - DNA, 32 bp, Artificial Sequence
  Primer R-ilvC(B.s.)-NotI
aagcggccgcttaattttgcgcaacggagacc

SEQ ID NO: 173 - DNA, 30 bp, Artificial Sequence
  Primer F-PnisA(HindIII)
ttaagcttgacatacttgaatgacctagtc

SEQ ID NO: 174 - DNA, 39 bp, Artificial Sequence
  Primer R-PnisA(SpeI BamHI)
ttggatccaaactagtataatttattttgtagttccttc

SEQ ID NO: 175 - DNA, 38 bp, Artificial Sequence
  Primer N191
atccgcggatagatctcccattaccgacatttgggcgc

SEQ ID NO: 176 - DNA, 31 bp, Artificial Sequence
  Primer N192
atcctcagcgatgattgattgattgattgta

SEQ ID NO: 177 - DNA, 6509 bp, Artificial Sequence
  Vector pFP988
tcgaggccccgcacatacgaaaagactggctgaaaacattgagcctttgatgactgatgatttggctgaagaagtggatcgattgtttgagaaaagaagaagaccataaaaataccttgtctgtcatcagacagggtattttttatgctgtccagactgtccgctgtgtaaaaaataggaataaaggggggttgttattattttactgatatgtaaaatataatttgtataaggaattgtgagcggataacaattcctacgaaaatgagagggagaggaaacatgattcaaaaacgaaagcggacagtttcgttcagacttgtgcttatgtgcacgctgttatttgtcagtttgccgattacaaaaacatcagccggatcccaccatcaccatcaccattaagaattcctagaaactccaagctatctttaaaaaatctagtaaatgcacgagcaacatcttttgttgctcagtgcattttttattttgtacactagatatttcttctccgcttaaatcatcaaagaaatctttatcacttgtaaccagtccgtccacatgtcgaattgcatctgaccgaattttacgtttccctgaataattctcatcaatcgtttcatcaattttatctttatactttatattttgtgcgttaatcaaatcataatttttatatgtttcctcatgatttatgtctttattattatagtttttattctctctttgattatgtctttgtatcccgtttgtattacttgatcctttaactctggcaaccctcaaaattgaatgagacatgctacacctccggataataaatatatataaacgtatatagatttcataaagtctaacacactagacttatttacttcgtaattaagtcgttaaaccgtgtgctctacgaccaaaactataaaacctttaagaactttctttttttacaagaaaaaagaaattagataaatctctcatatcttttattcaataatcgcatccgattgcagtataaatttaacgatcactcatcatgttcatatttatcagagctcgtgctataattatactaattttataaggaggaaaaaatatgggcatttttagtatttttgtaatcagcacagttcattatcaaccaaacaaaaaataagtggttataatgaatcgttaataagcaaaattcatataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtaaagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatatggtaatataccttataacataagtacggatataatacgcaaaattgtttttgatagtatagctaatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaagtagaaaaaaatcaagaatatcacacaaagataaacaaaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttgcatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactctttttgtttatttttctaaatacattcaaatatgtatccgctcatgctccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttcatgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcatgccacgcgtc

SEQ ID NO: 178 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 179 - DNA, 1665 bp, Lactococcus lactis
atgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattga

SEQ ID NO: 180 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 181 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 182 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 183 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 184 - DNA, 1476 bp, Bacillus subtilis; identical to SEQ ID NO: 3

SEQ ID NO: 185 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 186 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 187 - DNA, 1653 bp, Methanococcus maripaludis
atgataagtgataacgtcaaaaagggagttataagaactccaaaccgagctcttttaaaggcttgcggatatacagacgaagacatggaaaaaccatttattggaattgtaaacagctttacagaagttgttcccggccacattcacttaagaacattatcagaagcggctaaacatggtgtttatgcaaacggtggaacaccatttgaatttaataccattggaatttgcgacggtattgcaatgggccacgaaggtatgaaatactctttaccttcaagagaaattattgcagacgctgttgaatcaatggcaagagcacatggatttgatggtcttgttttaattcctacgtgtgataaaatcgttcctggaatgataatgggtgctttaagactaaacattccatttattgtagttactggaggaccaatgcttcccggagaattccaaggtaaaaaatacgaacttatcagcctttttgaaggtgtcggagaataccaagttggaaaaattactgaagaagagttaaagtgcattgaagactgtgcatgttcaggtgctggaagttgtgcagggctttacactgcaaacagtatggcctgccttacagaagctttgggactctctcttccaatgtgtgcaacaacgcatgcagttgatgcccaaaaagttaggcttgctaaaaaaagtggctcaaaaattgttgatatggtaaaagaagacctaaaaccaacagacatattaacaaaagaagcttttgaaaatgctattttagttgaccttgcacttggtggatcaacaaacacaacattacacattcctgcaattgcaaatgaaattgaaaataaattcataactctcgatgactttgacaggttaagcgatgaagttccacacattgcatcaatcaaaccaggtggagaacactacatgattgatttacacaatgctggaggtattcctgcggtattgaacgttttaaaagaaaaaattagagatacaaaaacagttgatggaagaagcattttggaaatcgcagaatctgttaaatacataaattacgacgttataagaaaagtggaagctccggttcacgaaactgctggtttaagggttttaaagggaaatcttgctccaaacggttgcgttgtaaaaatcggtgcagtacatccgaaaatgtacaaacacgatggacctgcaaaagtttacaattccgaagatgaagcaatttctgcgatacttggcggaaaaattgtagaaggggacgttatagtaatcagatacgaaggaccatcaggaggccctggaatgagagaaatgctctccccaacttcagcaatctgtggaatgggtcttgatgacagcgttgcattgattactgatggaagattcagtggtggaagtaggggcccatgtatcggacacgtttctccagaagctgcagctggcggagtaattgctgcaattgaaaacggggatatcatcaaaatcgacatgattgaaaaagaaataaatgttgatttagatgaatcagtcattaaagaaagactctcaaaactgggagaatttgagcctaaaatcaaaaaaggctatttatcaagatactcaaaacttgtctcatctgctgacgaaggggcagttttaaaataa

SEQ ID NO: 188 - protein, 550 aa, Methanococcus maripaludis
MISDNVKKGVIRTPNRALLKACGYTDEDMEKPFIGIVNSFTEVVPGHIHLRTLSEAAKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKYELISLFEGVGEYQVGKITEEELKCIEDCACSGAGSCAGLYTANSMACLTEALGLSLPMCATTHAVDAQKVRLAKKSGSKIVDMVKEDLKPTDILTKEAFENAILVDLALGGSTNTTLHIPAIANEIENKFITLDDFDRLSDEVPHIASIKPGGEHYMIDLHNAGGIPAVLNVLKEKIRDTKTVDGRSILEIAESVKYINYDVIRKVEAPVHETAGLRVLKGNLAPNGCVVKIGAVHPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIEKEINVDLDESVIKERLSKLGEFEPKIKKGYLSRYSKLVSSADEGAVLK

SEQ ID NO: 189 - DNA, 1677 bp, Bacillus subtilis
atggcagaattacgcagtaatatgatcacacaaggaatcgatagagctccgcaccgcagtttgcttcgtgcagcaggggtaaaagaagaggatttcggcaagccgtttattgcggtgtgtaattcatacattgatatcgttcccggtcatgttcacttgcaggagtttgggaaaatcgtaaaagaagcaatcagagaagcagggggcgttccgtttgaatttaataccattggggtagatgatggcatcgcaatggggcatatcggtatgagatattcgctgccaagccgtgaaattatcgcagactctgtggaaacggttgtatccgcacactggtttgacggaatggtctgtattccgaactgcgacaaaatcacaccgggaatgcttatggcggcaatgcgcatcaacattccgacgatttttgtcagcggcggaccgatggcggcaggaagaacaagttacgggcgaaaaatctccctttcctcagtattcgaaggggtaggcgcctaccaagcagggaaaatcaacgaaaacgagcttcaagaactagagcagttcggatgcccaacgtgcgggtcttgctcaggcatgtttacggcgaactcaatgaactgtctgtcagaagcacttggtcttgctttgccgggtaatggaaccattctggcaacatctccggaacgcaaagagtttgtgagaaaatcggctgcgcaattaatggaaacgattcgcaaagatatcaaaccgcgtgatattgttacagtaaaagcgattgataacgcgtttgcactcgatatggcgctcggaggttctacaaataccgttcttcatacccttgcccttgcaaacgaagccggcgttgaatactctttagaacgcattaacgaagtcgctgagcgcgtgccgcacttggctaagctggcgcctgcatcggatgtgtttattgaagatcttcacgaagcgggcggcgtttcagcggctctgaatgagctttcgaagaaagaaggagcgcttcatttagatgcgctgactgttacaggaaaaactcttggagaaaccattgccggacatgaagtaaaggattatgacgtcattcacccgctggatcaaccattcactgaaaagggaggccttgctgttttattcggtaatctagctccggacggcgctatcattaaaacaggcggcgtacagaatgggattacaagacacgaagggccggctgtcgtattcgattctcaggacgaggcgcttgacggcattatcaaccgaaaagtaaaagaaggcgacgttgtcatcatcagatacgaagggccaaaaggcggacctggcatgccggaaatgctggcgccaacatcccaaatcgttggaatgggactcgggccaaaagtggcattgattacggacggacgtttttccggagcctcccgtggcctctcaatcggccacgtatcacctgaggccgctgagggcgggccgcttgcctttgttgaaaacggagaccatattatcgttgatattgaaaaacgcatcttggatgtacaagtgccagaagaagagtgggaaaaacgaaaagcgaactggaaaggttttgaaccgaaagtgaaaaccggctacctggcacgttattctaaacttgtgacaagtgccaacaccggcggtattatgaaaatctag

SEQ ID NO: 190 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSYGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 191 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 192 - DNA, 1644 bp, Lactococcus lactis
atgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatag

SEQ ID NO: 193 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 194 - DNA, 1653 bp, Salmonella typhimurium
ttatcccccgttgcgggcttccagcgcccgggtcacggtacgcagtaattccggcagatcggcttttggcaacatcacttcaataaatgacagacgttgtgggcgcgccaaccgttcgaggacctctgccagttggatagcctgcgtcacccgccagcactccgcctgttgcgccgcgtttagcgccggtggtatctgcgtccagttccagctcgcgatgtcgttataccgctgggccgcgccgtgaatggcgcgctctacggtatagccgtcattgttgagcagcaggatgaccggcgcctgcccgtcgcgtaacatcgagcccatctcctgaatcgtgagctgcgccgcgccatcgccgataatcagaatcacccgccgatcgggacaggcggtttgcgcgccaaacgcggcgggcaaggaatagccgatagacccccacagcggctgtaacacaacttccgcgccgtcaggaagcgacagcgcggcagcgccaaaagctgctgtcccctggtcgacaaggataatatctccgggtttgagatactgctgtaaggtttgccagaagctttcctgggtcagttctcctttatcaatccgcactggctgtccggcggaacgcgtcggcggcggcgcaaaagcgcattccaggcacagttcgcgcagcgtagacaccgcctgcgccatcgggaggttgaaccaggtttcgccgatgcgcgacgcgtaaggctgaatctccagcgtgcgttccgccggtaattgttgggtaaatccggccgtaagggtatcgacaaaacgggtgccgacgcagataaccctatcggcgtcctctatggcctgacgcacttctttgctgctggcgccagcgctataggtgccaacgaagttcgggtgctgttcatcaaaaagccccttccccatcagtagtgtcgcatgagcgatgggcgtttccgccatccagcgctgcaacagtggtcgtaaaccaaaacgcccggcaagaaagtcggccaatagcgcaatgcgccgactgttcatcaggcactgacgggcgtgataacgaaaggccgtctccacgccgctttgcgcttcatgcacgggcaacgccagcgcctgcgtaggtgggatggccgtttttttcgccacatcggcgggcaacatgatgtatcctggcctgcgtgcggcaagcatttcacccaacacgcggtcaatctcgaaacaggcgttctgttcatctaatattgcgctggcagcggatatcgcctgactcatgcgataaaaatgacgaaaatcgccgtcaccgagggtatggtgcatcaattcgccacgctgctgcgcagcgctacagggcgcgccgacgatatgcaagaccgggacatattccgcgtaactgcccgcgataccgttaatagcgctaagttctcccacgccaaaggtggtgagtagcgctccagcgcccgacatgcgcgcatagccgtccgcggcataagcggcgttcagctcattggcgcatcccacccaacgcagggtcgggtggtcaatcacatggtcaagaaactgcaagttataatcgcccggtacgccaaaaagatggccaatgccgcatcctgccagtctgtccagcaaatagtcggccacggtataggggttttgcat

SEQ ID NO: 195 - protein, 550 aa, Salmonella typhimurium
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 196 - DNA, 1665 bp, Clostridium acetobutylicum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 197 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 198 - DNA, 939 bp, Saccharomyces cerevisiae
atgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcagggctattaaagattccggagtccctcgtgaggaaatttttattactactaagctttggggtacggaacaacgtgatccggaagctgctctaaacaagtctttgaaaagactaggcttggattatgttgacctatatctgatgcattggccagtgcctttgaaaaccgacagagttactgatggtaacgttctgtgcattccaacattagaagatggcactgttgacatcgatactaaggaatggaattttatcaagacgtgggagttgatgcaagagttgccaaagacgggcaaaactaaagccgttggtgtctctaatttttctattaacaacattaaagaattattagaatctccaaataacaaggtggtaccagctactaatcaaattgaaattcatccattgctaccacaagacgaattgattgccttttgtaaggaaaagggtattgttgttgaagcctactcaccatttgggagtgctaatgctcctttactaaaagagcaagcaattattgatatggctaaaaagcacggcgttgagccagcacagcttattatcagttggagtattcaaagaggctacgttgttctggccaaatcggttaatcctgaaagaattgtatccaattttaagattttcactctgcctgaggatgatttcaagactattagtaacctatccaaagtgcatggtacaaagagagtcgttgatatgaagtggggatccttcccaattttccaatga

SEQ ID NO: 199 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 200 - DNA, 1083 bp, Saccharomyces cerevisiae
ctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacat

SEQ ID NO: 201 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 202 - DNA, 1170 bp, Clostridium acetobutylicum
ttaataagattttttaaatatctcaagaacatcctctgcatttattggtcttaaacttcctattgttcctccagaatttctaacagcttgctttgccattagttctagtttatcttttcctattccaacttctctaagctttgaaggaatacccaatgaattaaagtattctctcgtatttttaatagcctctcgtgctatttcatagttatctttgttcttgtctattccccaaacatttattccataagaaacaaatttatgaagtgtatcgtcatttagaatatattccatccaattaggtgttaaaattgcaagtcctacaccatgtgttatatcataatatgcacttaactcgtgttccataggatgacaactccattttctatccttaccaagtgataatagaccatttatagctaaacttgaagcccacatcaaattagctctagcctcgtaatcatcagtcttctccattgctatttttccatactttatacatgttcttaagattgcttctgctataccgtcctgcacataagcaccttcaacaccactaaagtaagattcaaaggtgtgactcataatgtcagctgttcccgctgctgtttgatttttaggtactgtaaaagtatatgtaggatctaacactgaaaatttaggtctcatatcatcatgtcctactccaagcttttcattagtctccatatttgaaattactgcaatttgatccatttcagaccctgttgctgaaagagtaagtatacttgcaattggaagaactttagttattttagatggatctttaaccatgtcccatgtatcgccatcataataaactccagctgcaattaccttagaacagtctattgcacttcctccccctattgctaatactaaatccacattattttctctacatatttctatgcctttttttactgttgttatcctaggatttggctctactcctgaaagttcatagaaagctatattgttttcttttaatatagctgttgctctatcatatataccgttcctttttatacttcctccgccataaactataagcactcttgagccatatttcttaatttcttctccaattacgtctatttttccttttccaaaaaaaactttagttggtattgaataatcaaaacttagcat

SEQ ID NO: 203 - protein, 389 aa, Clostridium acetobutylicum
MLSFDYSIPTKVFFGKGKIDVIGEEIKKYGSRVLIVYGGGSIKRNGIYDRATAILKENNIAFYELSGVEPNPRITTVKKGIEICRENNVDLVLAIGGGSAIDCSKVIAAGVYYDGDTWDMVKDPSKITKVLPIASILTLSATGSEMDQIAVISNMETNEKLGVGHDDMRPKFSVLDPTYTFTVPKNQTAAGTADIMSHTFESYFSGVEGAYVQDGIAEAILRTCIKYGKIAMEKTDDYEARANLMWASSLAINGLLSLGKDRKWSCHPMEHELSAYYDITHGVGLAILTPNWMEYILNDDTLHKFVSYGINVWGIDKNKDNYEIAREAIKNTREYFNSLGIPSKLREVGIGKDKLELMAKQAVRNSGGTIGSLRPINAEDVLEIFKKSY

SEQ ID NO: 204 - protein, 390 aa, Clostridium acetobutylicum
MVDFEYSIPTRIFFGKDKINVLGRELKKYGSKVLIVYGGGSIKRNGIYDKAVSILEKNSIKFYELAGVEPNPRVTTVEKGVKICRENGVEVVLAIGGGSAIDCAKVIAAACEYDGNPWDIVLDGSKIKRVLPIASILTIAATGSEMDTWAVINNMDTNEKLIAAHPDMAPKFSILDPTYTYTVPTNQTAAGTADIMSHIFEVYFSNTKTAYLQDRMAEALLRTCIKYGGIALEKPDDYEARANLMWASSLAINGLLTYGKDTNWSVHLMEHELSAYYDITHGVGLAILTPNWMEYILNNDTVYKFVEYGVNVWGIDKEKNHYDIAHQAIQKTRDYFVNVLGLPSRLRDVGIEEEKLDIMAKESVKLTGGTIGNLRPVNASEVLQIFKKSV

SEQ ID NO: 205 - DNA, 993 bp, Bacillus subtilis
atgagtacaaaccgacatcaagcactagggctgactgatcaggaagccgttgatatgtatagaaccatgctgttagcaagaaaaatcgatgaaagaatgtggctgttaaaccgttctggcaaaattccatttgtaatctcttgtcaaggacaggaagcagcacaggtaggagcggctttcgcacttgaccgtgaaatggattatgtattgccgtactacagagacatgggtgtcgtgctcgcgtttggcatgacagcaaaggacttaatgatgtccgggtttgcaaaagcagcagatccgaactcaggaggccgccagatgccgggacatttcggacaaaagaaaaaccgcattgtgacgggatcatctccggttacaacgcaagtgccgcacgcagtcggtattgcgcttgcgggacgtatggagaaaaaggatatcgcagcctttgttacattcggggaagggtcttcaaaccaaggcgatttccatgaaggggcaaactttgccgctgtccataagctgccggttattttcatgtgtgaaaacaacaaatacgcaatctcagtgccttacgataagcaagtcgcatgtgagaacatttccgaccgtgccataggctatgggatgcctggcgtaactgtgaatggaaatgatccgctggaagtttatcaagcggttaaagaagcacgcgaaagggcacgcagaggagaaggcccgacattaattgaaacgatttcttaccgccttacaccacattccagtgatgacgatgacagcagctacagaggccgtgaagaagtagaggaagcgaaaaaaagtgatcccctgcttacttatcaagcttacttaaaggaaacaggcctgctgtccgatgagatagaacaaaccatgctggatgaaattatggcaatcgtaaatgaagcgacggatgaagcggagaacgccccatatgcagctcctgagtcagcgcttgattatgtttatgcgaagtag

SEQ ID NO: 206 - protein, 330 aa, Bacillus subtilis
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 207 - DNA, 984 bp, Bacillus subtilis
atgtcagtaatgtcatatattgatgcaatcaatttggcgatgaaagaagaaatggaacgagattctcgcgttttcgtccttggggaagatgtaggaagaaaaggcggtgtgtttaaagcgacagcgggactctatgaacaatttggggaagagcgcgttatggatacgccgcttgctgaatctgcaatcgcaggagtcggtatcggagcggcaatgtacggaatgagaccgattgctgaaatgcagtttgctgatttcattatgccggcagtcaaccaaattatttctgaagcggctaaaatccgctaccgcagcaacaatgactggagctgtccgattgtcgtcagagcgccatacggcggaggcgtgcacggagccctgtatcattctcaatcagtcgaagcaattttcgccaaccagcccggactgaaaattgtcatgccatcaacaccatatgacgcgaaagggctcttaaaagccgcagttcgtgacgaagaccccgtgctgttttttgagcacaagcgggcataccgtctgataaagggcgaggttccggctgatgattatgtcctgccaatcggcaaggcggacgtaaaaagggaaggcgacgacatcacagtgatcacatacggcctgtgtgtccacttcgccttacaagctgcagaacgtctcgaaaaagatggcatttcagcgcatgtggtggatttaagaacagtttacccgcttgataaagaagccatcatcgaagctgcgtccaaaactggaaaggttcttttggtcacagaagatacaaaagaaggcagcatcatgagcgaagtagccgcaattatatccgagcattgtctgttcgacttagacgcgccgatcaaacggcttgcaggtcctgatattccggctatgccttatgcgccgacaatggaaaaatactttatggtcaaccctgataaagtggaagcggcgatgagagaattagcggagttttaa

SEQ ID NO: 208 - protein, 327 aa, Bacillus subtilis
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 209 - DNA, 1275 bp, Bacillus subtilis
atggcaattgaacaaatgacgatgccgcagcttggagaaagcgtaacagaggggacgatcagcaaatggcttgtcgcccccggtgataaagtgaacaaatacgatccgatcgcggaagtcatgacagataaggtaaatgcagaggttccgtcttcttttactggtacgataacagagcttgtgggagaagaaggccaaaccctgcaagtcggagaaatgatttgcaaaattgaaacagaaggcgcgaatccggctgaacaaaaacaagaacagccagcagcatcagaagccgctgagaaccctgttgcaaaaagtgctggagcagccgatcagcccaataaaaagcgctactcgccagctgttctccgtttggccggagagcacggcattgacctcgatcaagtgacaggaactggtgccggcgggcgcatcacacgaaaagatattcagcgcttaattgaaacaggcggcgtgcaagaacagaatcctgaggagctgaaaacagcagctcctgcaccgaagtctgcatcaaaacctgagccaaaagaagagacgtcatatcctgcgtctgcagccggtgataaagaaatccctgtcacaggtgtaagaaaagcaattgcttccaatatgaagcgaagcaaaacagaaattccgcatgcttggacgatgatggaagtcgacgtcacaaatatggttgcatatcgcaacagtataaaagattcttttaagaagacagaaggctttaatttaacgttcttcgccttttttgtaaaagcggtcgctcaggcgttaaaagaattcccgcaaatgaatagcatgtgggcgggggacaaaattattcagaaaaaggatatcaatatttcaattgcagttgccacagaggattctttatttgttccggtgattaaaaacgctgatgaaaaaacaattaaaggcattgcgaaagacattaccggcctagctaaaaaagtaagagacggaaaactcactgcagatgacatgcagggaggcacgtttaccgtcaacaacacaggttcgttcgggtctgttcagtcgatgggcattatcaactaccctcaggctgcgattcttcaagtagaatccatcgtcaaacgcccggttgtcatggacaatggcatgattgctgtcagagacatggttaatctgtgcctgtcattagatcacagagtgcttgacggtctcgtgtgcggacgattcctcggacgagtgaaacaaattttagaatcgattgacgagaagacatctgtttactaa

SEQ ID NO: 210 - protein, 424 aa, Bacillus subtilis
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 211 - DNA, 1374 bp, Bacillus subtilis
atggcaactgagtatgacgtagtcattctgggcggcggtaccggcggttatgttgcggccatcagagccgctcagctcggcttaaaaacagccgttgtggaaaaggaaaaactcgggggaacatgtctgcataaaggctgtatcccgagtaaagcgctgcttagaagcgcagaggtataccggacagctcgtgaagccgatcaattcggagtggaaacggctggcgtgtccctcaactttgaaaaagtgcagcagcgtaagcaagccgttgttgataagcttgcagcgggtgtaaatcatttaatgaaaaaaggaaaaattgacgtgtacaccggatatggacgtatccttggaccgtcaatcttctctccgctgccgggaacaatttctgttgagcggggaaatggcgaagaaaatgacatgctgatcccgaaacaagtgatcattgcaacaggatcaagaccgagaatgcttccgggtcttgaagtggacggtaagtctgtactgacttcagatgaggcgctccaaatggaggagctgccacagtcaatcatcattgtcggcggaggggttatcggtatcgaatgggcgtctatgcttcatgattttggcgttaaggtaacggttattgaatacgcggatcgcatattgccgactgaagatctagagatttcaaaagaaatggaaagtcttcttaagaaaaaaggcatccagttcataacaggggcaaaagtgctgcctgacacaatgacaaaaacatcagacgatatcagcatacaagcggaaaaagacggagaaaccgttacctattctgctgagaaaatgcttgtttccatcggcagacaggcaaatatcgaaggcatcggcctagagaacaccgatattgttactgaaaatggcatgatttcagtcaatgaaagctgccaaacgaaggaatctcatatttatgcaatcggagacgtaatcggtggcctgcagttagctcacgttgcttcacatgagggaattattgctgttgagcattttgcaggtctcaatccgcatccgcttgatccgacgcttgtgccgaagtgcatttactcaagccctgaagctgccagtgtcggcttaaccgaagacgaagcaaaggcgaacgggcataatgtcaaaatcggcaagttcccatttatggcgattggaaaagcgcttgtatacggtgaaagcgacggttttgtcaaaatcgtggctgaccgagatacagatgatattctcggcgttcatatgattggcccgcatgtcaccgacatgatttctgaagcgggtcttgccaaagtgctggacgcaacaccgtgggaggtcgggcaaacgatttcacccgcatccaacgctttctga

SEQ ID NO: 212 - protein, 457 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTISPASNAF

SEQ ID NO: 213 - DNA, 1233 bp, Pseudomonas putida
atgaacgagtacgcccccctgcgtttgcatgtgcccgagcccaccggccggccaggctgccagaccgatttttcctacctgcgcctgaacgatgcaggtcaagcccgtaaaccccctgtcgatgtcgacgctgccgacaccgccgacctgtcctacagcctggtccgcgtgctcgacgagcaaggcgacgcccaaggcccgtgggctgaagacatcgacccgcagatcctgcgccaaggcatgcgcgccatgctcaagacgcggatcttcgacagccgcatggtggttgcccagcgccagaagaagatgtccttctacatgcagagcctgggcgaagaagccatcggcagcggccaggcgctggcgcttaaccgcaccgacatgtgcttccccacctaccgtcagcaaagcatcctgatggcccgcgacgtgtcgctggtggagatgatctgccagttgctgtccaacgaacgcgaccccctcaagggccgccagctgccgatcatgtactcggtacgcgaggccggcttcttcaccatcagcggcaacctggcgacccagttcgtgcaggcggtcggctgggccatggcctcggcgatcaagggcgataccaagattgcctcggcctggatcggcgacggcgccactgccgaatcggacttccacaccgccctcacctttgcccacgtttaccgcgccccggtgatcctcaacgtggtcaacaaccagtgggccatctcaaccttccaggccatcgccggtggcgagtcgaccaccttcgccggccgtggcgtgggctgcggcatcgcttcgctgcgggtggacggcaacgacttcgtcgccgtttacgccgcttcgcgctgggctgccgaacgtgcccgccgtggtttgggcccgagcctgatcgagtgggtcacctaccgtgccggcccgcactcgacctcggacgacccgtccaagtaccgccctgccgatgactggagccacttcccgctgggtgacccgatcgcccgcctgaagcagcacctgatcaagatcggccactggtccgaagaagaacaccaggccaccacggccgagttcgaagcggccgtgattgctgcgcaaaaagaagccgagcagtacggcaccctggccaacggtcacatcccgagcgccgcctcgatgttcgaggacgtgtacaaggagatgcccgaccacctgcgccgccaacgccaggaactgggggtttga

SEQ ID NO: 214 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASMFEDVYKEMPDHLRRQRQELGV

SEQ ID NO: 215 - DNA, 1059 bp, Pseudomonas putida
atgaacgaccacaacaacagcatcaacccggaaaccgccatggccaccactaccatgaccatgatccaggccctgcgctcggccatggatgtcatgcttgagcgcgacgacaatgtggtggtgtacggccaggacgtcggctacttcggcggcgtgttccgctgcaccgaaggcctgcagaccaagtacggcaagtcccgcgtgttcgacgcgcccatctctgaaagcggcatcgtcggcaccgccgtgggcatgggtgcctacggcctgcgcccggtggtggaaatccagttcgctgactacttctacccggcctccgaccagatcgtttctgaaatggcccgcctgcgctaccgttcggccggcgagttcatcgccccgctgaccctgcgtatgccctgcggtggcggtatctatggcggccagacacacagccagagcccggaagcgatgttcactcaggtgtgcggcctgcgcaccgtaatgccatccaacccgtacgacgccaaaggcctgctgattgcctcgatcgaatgcgacgacccggtgatcttcctggagcccaagcgcctgtacaacggcccgttcgacggccaccatgaccgcccggttacgccgtggtcgaaacacccgcacagcgccgtgcccgatggctactacaccgtgccactggacaaggccgccatcacccgccccggcaatgacgtgagcgtgctcacctatggcaccaccgtgtacgtggcccaggtggccgccgaagaaagtggcgtggatgccgaagtgatcgacctgcgcagcctgtggccgctagacctggacaccatcgtcgagtcggtgaaaaagaccggccgttgcgtggtagtacacgaggccacccgtacttgtggctttggcgcagaactggtgtcgctggtgcaggagcactgcttccaccacctggaggcgccgatcgagcgcgtcaccggttgggacaccccctaccctcacgcgcaggaatgggcttacttcccagggccttcgcgggtaggtgcggcattgaaaaaggtcatggaggtctga

SEQ ID NO: 216 - protein, 352 aa, Pseudomonas putida
MNDHNNSINPETAMATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 217 - DNA, 1272 bp, Pseudomonas putida
atgggcacgcacgtcatcaagatgccggacattggcgaaggcatcgcgcaggtcgaattggtggaatggttcgtcaaggtgggcgacatcatcgccgaggaccaagtggtagccgacgtcatgaccgacaaggccaccgtggaaatcccgtcgccggtcagcggcaaggtgctggccctgggtggccagccaggtgaagtgatggcggtcggcagtgagctgatccgcatcgaagtggaaggcagcggcaaccatgtggatgtgccgcaagccaagccggccgaagtgcctgcggcaccggtagccgctaaacctgaaccacagaaagacgttaaaccggcggcgtaccaggcgtcagccagccacgaggcagcgcccatcgtgccgcgccagccgggcgacaagccgctggcctcgccggcggtgcgcaaacgcgccctcgatgccggcatcgaattgcgttatgtgcacggcagcggcccggccgggcgcatcctgcacgaagacctcgacgcgttcatgagcaaaccgcaaagcgctgccgggcaaacccccaatggctatgccaggcgcaccgacagcgagcaggtgccggtgatcggcctgcgccgcaagatcgcccagcgcatgcaggacgccaagcgccgggtcgcgcacttcagctatgtggaagaaatcgacgtcaccgccctggaagccctgcgccagcagctcaacagcaagcacggcgacagccgcggcaagctgacactgctgccgttcctggtgcgcgccctggtcgtggcactgcgtgacttcccgcagataaacgccacctacgatgacgaagcgcagatcatcacccgccatggcgcggtgcatgtgggcatcgccacccaaggtgacaacggcctgatggtacccgtgctgcgccacgccgaagcgggcagcctgtgggccaatgccggtgagatttcacgcctggccaacgctgcgcgcaacaacaaggccagccgcgaagagctgtccggttcgaccattaccctgaccagcctcggcgccctgggcggcatcgtcagcacgccggtggtcaacaccccggaagtggcgatcgtcggtgtcaaccgcatggttgagcggcccgtggtgatcgacggccagatcgtcgtgcgcaagatgatgaacctgtccagctcgttcgaccaccgcgtggtcgatggcatggacgccgccctgttcatccaggccgtgcgtggcctgctcgaacaacccgcctgcctgttcgtggagtga

SEQ ID NO: 218 - protein, 423 aa, Pseudomonas putida
MGTHVIKMPDIGEGIAQVELVEWFVKVGDIIAEDQVVADVMTDKATVEIPSPVSGKVLALGGQPGEVMAVGSELIRIEVEGSGNHVDVPQAKPAEVPAAPVAAKPEPQKDVKPAAYQASASHEAAPIVPRQPGDKPLASPAVRKRALDAGIELRYVHGSGPAGRILHEDLDAFMSKPQSAAGQTPNGYARRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 219 - DNA, 1380 bp, Pseudomonas putida
atgcaacagactatccagacaaccctgttgatcatcggcggcggccctggcggctatgtggcggccatccgcgccgggcaactgggcatccctaccgtgctggtggaaggccaggcgctgggcggtacctgcctgaacatcggctgcattccgtccaaggcgctgatccatgtggccgagcagttccaccaggcctcgcgctttaccgaaccctcgccgctgggcatcagcgtggcttcgccacgcctggacatcggccagagcgtggcctggaaagacggcatcgtcgatcgcctgaccactggtgtcgccgccctgctgaaaaagcacggggtgaaggtggtgcacggctgggccaaggtgcttgatggcaagcaggtcgaggtggatggccagcgcatccagtgcgagcacctgttgctggccacgggctccagcagtgtcgaactgccgatgctgccgttgggtgggccggtgatttcctcgaccgaggccctggcaccgaaagccctgccgcaacacctggtggtggtgggcggtggctacatcggcctggagctgggtatcgcctaccgcaagctcggcgcgcaggtcagcgtggtggaagcgcgcgagcgcatcctgccgacttacgacagcgaactgaccgccccggtggccgagtcgctgaaaaagctgggtatcgccctgcaccttggccacagcgtcgaaggttacgaaaatggctgcctgctggccaacgatggcaagggcggacaactgcgcctggaagccgaccgggtgctggtggccgtgggccgccgcccacgcaccaagggcttcaacctggaatgcctggacctgaagatgaatggtgccgcgattgccatcgacgagcgctgccagaccagcatgcacaacgtctgggccatcggcgacgtggccggcgaaccgatgctggcgcaccgggccatggcccagggcgagatggtggccgagatcatcgccggcaaggcacgccgcttcgaacccgctgcgatagccgccgtgtgcttcaccgacccggaagtggtcgtggtcggcaagacgccggaacaggccagtcagcaaggcctggactgcatcgtcgcgcagttcccgttcgccgccaacggccgggccatgagcctggagtcgaaaagcggtttcgtgcgcgtggtcgcgcggcgtgacaaccacctgatcctgggctggcaagcggttggcgtggcggtttccgagctgtccacggcgtttgcccagtcgctggagatgggtgcctgcctggaggatgtggccggtaccatccatgcccacccgaccctgggtgaagcggtacaggaagcggcactgcgtgccctgggccacgccctgcatatctga

SEQ ID NO: 220 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 221 - DNA, 1407 bp, Clostridium beijerinckii
atgaataaagacacactaatacctacaactaaagatttaaaattaaaaacaaatgttgaaaacattaatttaaagaactacaaggataattcttcatgtttcggagtattcgaaaatgttgaaaatgctataaacagcgctgtacacgcgcaaaagatattatcccttcattatacaaaagaacaaagagaaaaaatcataactgagataagaaaggccgcattagaaaataaagaggttttagctaccatgattctggaagaaacacatatgggaaggtatgaagataaaatattaaagcatgaattagtagctaaatatactcctggtacagaagatttaactactactgcttggtcaggtgataatggtcttacagttgtagaaatgtctccatatggcgttataggtgcaataactccttctacgaatccaactgaaactgtaatatgtaatagcatcggcatgatagctgctggaaatgctgtagtatttaacggacacccaggcgctaaaaaatgtgttgcttttgctattgaaatgataaataaagcaattatttcatgtggcggtcctgagaatttagtaacaactataaaaaatccaactatggaatccctagatgcaattattaagcatcctttaataaaacttctttgcggaactggaggtccaggaatggtaaaaaccctcttaaattctggcaagaaagctataggtgctggtgctggaaatccaccagttattgtagatgataccgctgatatagaaaaggctggtaagagtatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatagatttagtattacaaaaaaataatgaaactcaagaatactttataaacaaaaaatgggtaggaaaagatgcaaaattattctcagatgaaatagatgttgagtctccttcaaatattaaatgcatagtctgcgaagtaaatgcaaatcatccatttgtcatgacagaactcatgatgccaatattaccaattgtaagagttaaagatatagatgaagctgttaaatatacaaagatagcagaacaaaatagaaaacatagtgcctatatttattctaaaaatatagacaacctaaatagatttgaaagagaaattgatactactatttttgtaaagaatgctaaatcttttgctggtgttggttatgaagctgaaggatttacaactttcactattgctggatctactggtgaaggcataacctctgcaagaaattttacaagacaaagaagatgtgtacttgccggctaa

SEQ ID NO: 222 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 223 - DNA, 2589 bp, Clostridium acetobutylicum
atgaaagtcacaacagtaaaggaattagatgaaaaactcaaggtaattaaagaagctcaaaaaaaattctcttgttactcgcaagaaatggttgatgaaatctttagaaatgcagcaatggcagcaatcgacgcaaggatagagctagcaaaagcagctgttttggaaaccggtatgggcttagttgaagacaaggttataaaaaatcattttgcaggcgaatacatctataacaaatataaggatgaaaaaacctgcggtataattgaacgaaatgaaccctacggaattacaaaaatagcagaacctataggagttgtagctgctataatccctgtaacaaaccccacatcaacaacaatatttaaatccttaatatcccttaaaactagaaatggaattttcttttcgcctcacccaagggcaaaaaaatccacaatactagcagctaaaacaatacttgatgcagccgttaagagtggtgccccggaaaatataataggttggatagatgaaccttcaattgaactaactcaatatttaatgcaaaaagcagatataacccttgcaactggtggtccctcactagttaaatctgcttattcttccggaaaaccagcaataggtgttggtccgggtaacaccccagtaataattgatgaatctgctcatataaaaatggcagtaagttcaattatattatccaaaacctatgataatggtgttatatgtgcttctgaacaatctgtaatagtcttaaaatccatatataacaaggtaaaagatgagttccaagaaagaggagcttatataataaagaaaaacgaattggataaagtccgtgaagtgatttttaaagatggatccgtaaaccctaaaatagtcggacagtcagcttatactatagcagctatggctggcataaaagtacctaaaaccacaagaatattaataggagaagttacctccttaggtgaagaagaaccttttgcccacgaaaaactatctcctgttttggctatgtatgaggctgacaattttgatgatgctttaaaaaaagcagtaactctaataaacttaggaggcctcggccatacctcaggaatatatgcagatgaaataaaagcacgagataaaatagatagatttagtagtgccatgaaaaccgtaagaacctttgtaaatatcccaacctcacaaggtgcaagtggagatctatataattttagaataccaccttctttcacgcttggctgcggattttggggaggaaattctgtttccgagaatgttggtccaaaacatcttttgaatattaaaaccgtagctgaaaggagagaaaacatgctttggtttagagttccacataaagtatattttaagttcggttgtcttcaatttgctttaaaagatttaaaagatctaaagaaaaaaagagcctttatagttactgatagtgacccctataatttaaactatgttgattcaataataaaaatacttgagcacctagatattgattttaaagtatttaataaggttggaagagaagctgatcttaaaaccataaaaaaagcaactgaagaaatgtcctcctttatgccagacactataatagctttaggtggtacccctgaaatgagctctgcaaagctaatgtgggtactatatgaacatccagaagtaaaatttgaagatcttgcaataaaatttatggacataagaaagagaatatatactttcccaaaactcggtaaaaaggctatgttagttgcaattacaacttctgctggttccggttctgaggttactccttttgctttagtaactgacaataacactggaaataagtacatgttagcagattatgaaatgacaccaaatatggcaattgtagatgcagaacttatgatgaaaatgccaaagggattaaccgcttattcaggtatagatgcactagtaaatagtatagaagcatacacatccgtatatgcttcagaatacacaaacggactagcactagaggcaatacgattaatatttaaatatttgcctgaggcttacaaaaacggaagaaccaatgaaaaagcaagagagaaaatggctcacgcttcaactatggcaggtatggcatccgctaatgcatttctaggtctatgtcattccatggcaataaaattaagttcagaacacaatattcctagtggcattgccaatgcattactaatagaagaagtaataaaatttaacgcagttgataatcctgtaaaacaagccccttgcccacaatataagtatccaaacaccatatttagatatgctcgaattgcagattatataaagcttggaggaaatactgatgaggaaaaggtagatctcttaattaacaaaatacatgaactaaaaaaagctttaaatataccaacttcaataaaggatgcaggtgttttggaggaaaacttctattcctcccttgatagaatatctgaacttgcactagatgatcaatgcacaggcgctaatcctagatttcctcttacaagtgagataaaagaaatgtatataaattgttttaaaaaacaaccttaa

SEQ ID NO: 224 - protein, 862 aa, Clostridium acetobutylicum
MKVTTVKELDEKLKVIKEAQKKFSCYSQEMVDEIFRNAAMAAIDARIELAKAAVLETGMGLVEDKVIKNHFAGEYIYNKYKDEKTCGIIERNEPYGITKIAEPIGVVAAIIPVTNPTSTTIFKSLISLKTRNGIFFSPHPRAKKSTILAAKTILDAAVKSGAPENIIGWIDEPSIELTQYLMQKADITLATGGPSLVKSAYSSGKPAIGVGPGNTPVIIDESAHIKMAVSSIILSKTYDNGVICASEQSVIVLKSIYNKVKDEFQERGAYIIKKNELDKVREVIFKDGSVNPKIVGQSAYTIAAMAGIKVPKTTRILIGEVTSLGEEEPFAHEKLSPVLAMYEADNFDDALKKAVTLINLGGLGHTSGIYADEIKARDKIDRFSSAMKTVRTFVNIPTSQGASGDLYNFRIPPSFTLGCGFWGGNSVSENVGPKHLLNIKTVAERRENMLWFRVPHKVYFKFGCLQFALKDLKDLKKKRAFIVTDSDPYNLNYVDSIIKILEHLDIDFKVFNKVGREADLKTIKKATEEMSSFMPDTIIALGGTPEMSSAKLMWVLYEHPEVKFEDLAIKFMDIRKRIYTFPKLGKKAMLVAITTSAGSGSEVTPFALVTDNNTGNKYMLADYEMTPNMAIVDAELMMKMPKGLTAYSGIDALVNSIEAYTSVYASEYTNGLALEAIRLIFKYLPEAYKNGRTNEKAREKMAHASTMAGMASANAFLGLCHSMAIKLSSEHNIPSGIANALLIEEVIKFNAVDNPVKQAPCPQYKYPNTIFRYARIADYIKLGGNTDEEKVDLLINKIHELKKALNIPTSIKDAGVLEENFYSSLDRISELALDDQCTGANPRFPLTSEIKEMYINCFKKQP

SEQ ID NO: 225 - DNA, 2577 bp, Clostridium acetobutylicum
atgaaagttacaaatcaaaaagaactaaaacaaaagctaaatgaattgagagaagcgcaaaagaagtttgcaacctatactcaagagcaagttgataaaatttttaaacaatgtgccatagccgcagctaaagaaagaataaacttagctaaattagcagtagaagaaacaggaataggtcttgtagaagataaaattataaaaaatcattttgcagcagaatatatatacaataaatataaaaatgaaaaaacttgtggcataatagaccatgacgattctttaggcataacaaaggttgctgaaccaattggaattgttgcagccatagttcctactactaatccaacttccacagcaattttcaaatcattaatttctttaaaaacaagaaacgcaatattcttttcaccacatccacgtgcaaaaaaatctacaattgctgcagcaaaattaattttagatgcagctgttaaagcaggagcacctaaaaatataataggctggatagatgagccatcaatagaactttctcaagatttgatgagtgaagctgatataatattagcaacaggaggtccttcaatggttaaagcggcctattcatctggaaaacctgcaattggtgttggagcaggaaatacaccagcaataatagatgagagtgcagatatagatatggcagtaagctccataattttatcaaagacttatgacaatggagtaatatgcgcttctgaacaatcaatattagttatgaattcaatatacgaaaaagttaaagaggaatttgtaaaacgaggatcatatatactcaatcaaaatgaaatagctaaaataaaagaaactatgtttaaaaatggagctattaatgctgacatagttggaaaatctgcttatataattgctaaaatggcaggaattgaagttcctcaaactacaaagatacttataggcgaagtacaatctgttgaaaaaagcgagctgttctcacatgaaaaactatcaccagtacttgcaatgtataaagttaaggattttgatgaagctctaaaaaaggcacaaaggctaatagaattaggtggaagtggacacacgtcatctttatatatagattcacaaaacaataaggataaagttaaagaatttggattagcaatgaaaacttcaaggacatttattaacatgccttcttcacagggagcaagcggagatttatacaattttgcgatagcaccatcatttactcttggatgcggcacttggggaggaaactctgtatcgcaaaatgtagagcctaaacatttattaaatattaaaagtgttgctgaaagaagggaaaatatgctttggtttaaagtgccacaaaaaatatattttaaatatggatgtcttagatttgcattaaaagaattaaaagatatgaataagaaaagagcctttatagtaacagataaagatctttttaaacttggatatgttaataaaataacaaaggtactagatgagatagatattaaatacagtatatttacagatattaaatctgatccaactattgattcagtaaaaaaaggtgctaaagaaatgcttaactttgaacctgatactataatctctattggtggtggatcgccaatggatgcagcaaaggttatgcacttgttatatgaatatccagaagcagaaattgaaaatctagctataaactttatggatataagaaagagaatatgcaatttccctaaattaggtacaaaggcgatttcagtagctattcctacaactgctggtaccggttcagaggcaacaccttttgcagttataactaatgatgaaacaggaatgaaataccctttaacttcttatgaattgaccccaaacatggcaataatagatactgaattaatgttaaatatgcctagaaaattaacagcagcaactggaatagatgcattagttcatgctatagaagcatatgtttcggttatggctacggattatactgatgaattagccttaagagcaataaaaatgatatttaaatatttgcctagagcctataaaaatgggactaacgacattgaagcaagagaaaaaatggcacatgcctctaatattgcggggatggcatttgcaaatgctttcttaggtgtatgccattcaatggctcataaacttggggcaatgcatcacgttccacatggaattgcttgtgctgtattaatagaagaagttattaaatataacgctacagactgtccaacaaagcaaacagcattccctcaatataaatctcctaatgctaagagaaaatatgctgaaattgcagagtatttgaatttaaagggtactagcgataccgaaaaggtaacagccttaatagaagctatttcaaagttaaagatagatttgagtattccacaaaatataagtgccgctggaataaataaaaaagatttttataatacgctagataaaatgtcagagcttgcttttgatgaccaatgtacaacagctaatcctaggtatccacttataagtgaacttaaggatatctatataaaatcattttaa

SEQ ID NO: 226 - protein, 800 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISK

SEQ ID NO: 227 - DNA, 924 bp, Pseudomonas putida
atgagcaagaaactcaaggcggccatcataggccccggcaatatcggtaccgatctggtgatgaagatgctccgttccgagtggattgagccggtgtggatggtcggcatcgaccccaactccgacggcctcaaacgcgcccgcgatttcggcatgaagaccacagccgaaggcgtcgacggcctgctcccgcacgtgctggacgacgacatccgcatcgccttcgacgccacctcggcctatgtgcatgccgagaatagccgcaagctcaacgcgcttggcgtgctgatggtcgacctgaccccggcggccatcggcccctactgcgtgccgccggtcaacctcaagcagcatgtcggccgcctggaaatgaacgtcaacatggtcacctgcggcggccaggccaccatccccatggtcgccgcggtgtcccgcgtgcagccggtggcctacgccgagatcgtcgccaccgtctcctcgcgctcggtcggcccgggcacgcgcaagaacatcgacgagttcacccgcaccaccgccggcgccatcgagcaggtcggcggcgccagggaaggcaaggcgatcatcgtcatcaacccggccgagccgccgctgatgatgcgcgacaccatccactgcctgaccgacagcgagccggaccaggctgcgatcaccgcttcggttcacgcgatgatcgccgaggtgcagaaatacgtgcccggctaccgcctgaagaacggcccggtgttcgacggcaaccgcgtgtcgatcttcatggaagtcgaaggcctgggcgactacctgcccaagtacgccggcaacctcgacatcatgaccgccgccgcgctgcgtaccggcgagatgttcgccgaggaaatcgccgccggcaccattcaactgccgcgtcgcgacatcgcgctggcttga

SEQ ID NO: 228 - protein, 307 aa, Pseudomonas putida
MSKKLKAAIIGPGNIGTDLVMKMLRSEWIEPVWMVGIDPNSDGLKRARDFGMKTTAEGVDGLLPHVLDDDIRIAFDATSAYVHAENSRKLNALGVLMVDLTPAAIGPYCVPPVNLKQHVGRLEMNVNMVTCGGQATIPMVAAVSRVQPVAYAEIVATVSSRSVGPGTRKNIDEFTRTTAGAIEQVGGAREGKAIIVINPAEPPLMMRDTIHCLTDSEPDQAAITASVHAMIAEVQKYVPGYRLKNGPVFDGNRVSIFMEVEGLGDYLPKYAGNLDIMTAAALRTGEMFAEEIAAGTIQLPRRDIALA

SEQ ID NO: 229 - DNA, 924 bp, Thermus thermophilus
atgtccgaaagggttaaggtagccatcctgggctccggcaacatcgggacggacctgatgtacaagctcctgaagaacccgggccacatggagcttgtggcggtggtggggatagaccccaagtccgagggcctggcccgggcgcgggccttagggttagaggcgagccacgaagggatcgcctacatcctggagaggccggagatcaagatcgtctttgacgccaccagcgccaaggcccacgtgcgccacgccaagctcctgagggaggcggggaagatcgccatagacctcacgccggcggcccggggcccttacgtggtgcccccggtgaacctgaaggaacacctggacaaggacaacgtgaacctcatcacctgcggggggcaggccaccatccccctggtctacgcggtgcaccgggtggcccccgtgctctacgcggagatggtctccacggtggcctcccgctccgcgggccccggcacccggcagaacatcgacgagttcaccttcaccaccgcccggggcctggaggccatcgggggggccaagaaggggaaggccatcatcatcctgaacccggcggaaccccccatcctcatgaccaacaccgtgcgctgcatccccgaggacgagggctttgaccgggaggccgtggtggcgagcgtccgggccatggagcgggaggtccaggcctacgtgcccggctaccgcctgaaggcggacccggtgtttgagaggcttcccaccccctggggggagcgcaccgtggtctccatgctcctggaggtggagggggcgggggactatttgcccaaatacgccggcaacctggacatcatgacggcttctgcccggagggtgggggaggtcttcgcccagcacctcctggggaagcccgtggaggaggtggtggcgtga

SEQ ID NO: 230 - protein, 307 aa, Thermus thermophilus
MSERVKVAILGSGNIGTDLMYKLLKNPGHMELVAVVGIDPKSEGLARARALGLEASHEGIAYILERPEIKIVFDATSAKAHVRHAKLLREAGKIAIDLTPAARGPYVVPPVNLKEHLDKDNVNLITCGGQATIPLVYAVHRVAPVLYAEMVSTVASRSAGPGTRQNIDEFTFTTARGLEAIGGAKKGKAIIILNPAEPPILMTNTVRCIPEDEGFDREAVVASVRAMEREVQAYVPGYRLKADPVFERLPTPWGERTVVSMLLEVEGAGDYLPKYAGNLDIMTASARRVGEVFAQHLLGKPVEEVVA

SEQ ID NO: 231 - DNA, 1254 bp, Escherichia coli
atgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccaagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaa

SEQ ID NO: 232 - protein, 417 aa, Escherichia coli
MTFSLFGDKFTRHSGITLLMEDLNDGLRTPGAIMLGGGNPAQIPEMQDYFQTLLTDMLESGKATDALCNYDGPQGKTELLTLLAGMLREKLGWDIEPQNIALTNGSQSAFFYLFNLFAGRRADGRVKKVLFPLAPEYIGYADAGLEEDLFVSARPNIELLPEGQFKYHVDFEHLHIGEETGMICVSRPTNPTGNVITDEELLKLDALANQHGIPLVIDNAYGVPFPGIIFSEARPLWNPNIVLCMSLSKLGLPGSRCGIIIANEKIITAITNMNGIISLAPGGIGPAMMCEMIKRNDLLRLSETVIKPFYYQRVQETIAIIRRYLPENRCLIHKPEGAIFLWLWFKDLPITTKQLYQRLKARGVLMVPGHNFFPGLDKPWPHTHQCMRMNYVPEPEKIEAGVKILAEEIERAWAESH

SEQ ID NO: 233 - DNA, 1278 bp, Bacillus licheniformis
ttataagtattcaacctgtttctcatatacacccttcgcaattttagctaaaacatcgattccccttataatatcttcatccgccgcggttaggctgattcgtatacactggtgtgaatgcgccaggcgccgggattgacggtgaaagaaagatgatccgggaacgataatgactccatccgctttcatatactcatacagcgctgcatcggtcaccggcaggtcttcaaaccacagccatccgaaaagcgatccttccccttgatgcagataccatttgatgtcttcaggcatcttgcataaaagcgtttccttgagcagcatgaatttattgcggtaatatggcctgacttcattcagcgacacgtcggcgaggcgcccgtcattcaatactgatgcagccatatactgccccagccttgaagaatggatcgccgcattcgactgaaaagcttccattgcctgaatataccgggacggcccgatggcgattccgatcctttcgccaggcaggccggcttttgaaaggctcatacagtgaatgatctgctcgttgaaaatcggttccatgtcgataaagtgaatcgccggaaaaggcggagcatatgcggaatcaatgaacagcggaacattcgcttctcggcatgcgtctgaaatgaatgctacatcttctttaggcaagatgtttccgcaaggattgttcgggcgcgatagcaagacagcaccgatgcgcatcctctctaaaaaccccttacggtcgagctcatatcgaaacgtatgatcatccaatttcgatatgagcggagggatcccctcaatcatctcccgctccagtgccgccccgctgtatcccgaatagtcaggcagcatcgggatcaaggcttttttcatcacagatccgcttcccattccgcaaaacgaattgatcgccagaaaaaacagctgctggcttccggctgtaatcaacacgttctcttttcgaatgccggcgctataccgctctgaaaagaagcggacaacacttgcaatcagttcatcggttccatagctcgatccgtattggccgatcaccgaagaaaacctgtcatcgtcaaggagatcggcaagagccgacttccacatggctgacacgccgggcaaaatcatcggattgcccgcacttaaattaatgtatgaccgttcaccgccggccaggacttcctgaatatcgctcatcacagccctgacccctgttttctcaatcattttctctccgattttgcttaatggcggcttcac

SEQ ID NO: 234 - protein, 425 aa, Bacillus licheniformis
MKPPLSKIGEKMIEKTGVRAVMSDIQEVLAGGERSYINLSAGNPMILPGVSAMWKSALADLLDDDRFSSVIGQYGSSYGTDELIASVVRFFSERYSAGIRKENVLITAGSQQLFFLAINSFCGMGSGSVMKKALIPMLPDYSGYSGAALEREMIEGIPPLISKLDDHTFRYELDRKGFLERMRIGAVLLSRPNNPCGNILPKEDVAFISDACREANVPLFIDSAYAPPFPAIHFIDMEPIFNEQIIHCMSLSKAGLPGERIGIAIGPSRYIQAMEAFQSNAAIHSSRLGQYMAASVLNDGRLADVSLNEVRPYYRNKFMLLKETLLCKMPEDIKWYLHQGEGSLFGWLWFEDLPVTDAALYEYMKADGVIIVPGSSFFHRQSRRLAHSHQCIRISLTAADEDIIRGIDVLAKIAKGVYEKQVEYL

SEQ ID NO: 235 - DNA, 930 bp, Escherichia coli
atgaccacgaagaaagctgattacatttggttcaatggggagatggttcgctgggaagacgcgaaggtgcatgtgatgtcgcacgcgctgcactatggcacttcggtttttgaaggcatccgttgctacgactcgcacaaaggaccggttgtattccgccatcgtgagcatatgcagcgtctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagcaccaaacaccatcccgacggcggcaaaagccggtggtaactacctctcttccctgctggtgggtagcgaagcgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtacggcggcagaaatcacgccagtgcgcagcgtagacggtattcaggttggcgaaggccgttgtggcccggttaccaaacgcattcagcaagccttcttcggcctcttcactggcgaaaccgaagataaatggggctggttagatcaagttaatcaataa

SEQ ID NO: 236 - protein, 309 aa, Escherichia coli
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 237 - DNA, 1131 bp, Saccharomyces cerevisiae
atgaccttggcacccctagacgcctccaaagttaagataactaccacacaacatgcatctaagccaaaaccgaacagtgagttagtgtttggcaagagcttcacggaccacatgttaactgcggaatggacagctgaaaaagggtggggtaccccagagattaaaccttatcaaaatctgtctttagacccttccgcggtggttttccattatgcttttgagctattcgaagggatgaaggcttacagaacggtggacaacaaaattacaatgtttcgtccagatatgaatatgaagcgcatgaataagtctgctcagagaatctgtttgccaacgttcgacccagaagagttgattaccctaattgggaaactgatccagcaagataagtgcttagttcctgaaggaaaaggttactctttatatatcaggcctacattaatcggcactacggccggtttaggggtttccacgcctgatagagccttgctatatgtcatttgctgccctgtgggtccttattacaaaactggatttaaggcggtcagactggaagccactgattatgccacaagagcttggccaggaggctgtggtgacaagaaactaggtgcaaactacgccccctgcgtcctgccacaattgcaagctgcttcaaggggttaccaacaaaatttatggctatttggtccaaataacaacattactgaagtcggcaccatgaatgcttttttcgtgtttaaagatagtaaaacgggcaagaaggaactagttactgctccactagacggtaccattttggaaggtgttactagggattccattttaaatcttgctaaagaaagactcgaaccaagtgaatggaccattagtgaacgctacttcactataggcgaagttactgagagatccaagaacggtgaactacttgaagcctttggttctggtactgctgcgattgtttctcccattaaggaaatcggctggaaaggcgaacaaattaatattccgttgttgcccggcgaacaaaccggtccattggccaaagaagttgcacaatggattaatggaatccaatatggcgagactgagcatggcaattggtcaagggttgttactgatttgaactga

SEQ ID NO: 238 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 239 - DNA, 993 bp, Methanobacterium thermoautotrophicum
tcagatgtaggtgagccatccgaagctgtcctctgtctctgccctgattatcctgaagaactcatcctgcagcagctttgtaacgggaccccttcgcccggcacctatctctataccatcaactgatctgatgggtgttatctctgcggctgtacctgtgaagaaggcctcatctgcgatgtagagcatctccctggttatgggttcctcatgcacggtaacaccctcggtcctggctatctttattacggagtcccttgttatccccctcagaagggatgatgaaacagggggggtgtaaatttcaccctcactgacgaggaatatgttctccccgctaccctcacttatgtagccatggtagtccagcattatggcctcatcatagccgtgtctcacagcctccatcttggcaagctgtgagttgaggtagttaccgccggcctttgccatgttgggcattgtgtttggtgccatcctccgccaggttgaaacaccagcatcgacaccaacctcaagggcctctgcacccagataggccccccattcccaggcagccacagcgacgtccactgggcagttcaccgggtgaacacccatctcaccgtatcccctgaataccacgggtcttatatagcactcctcaagtccgttctccctgacggtctcaactatggcatcacatatctgctcctgggtgtagggtatgtccatccggtatatctttgcagaatcaaaaaggcgtttaacatgctcccgcaaacggaagatggctgaccccttactgttcctgtagcaccttattccctcaaagacagatgatccataatgcacaacatgtgagagtacgtggacggtggcttcttcccattcaaccatttcaccgtttaaccatatctttccactggcttcgcatgacatgataataacctcaggtgatttactaggataggttatggttggaggcctatataatgctctccataaccgcaa

SEQ ID NO: 240 - protein, 330 aa, Methanobacterium thermoautotrophicum
MRLWRALYRPPTITYPSKSPEVIIMSCEASGKIWLNGEMVEWEEATVHVLSHVVHYGSSVFEGIRCYRNSKGSAIFRLREHVKRLFDSAKIYRMDIPYTQEQICDAIVETVRENGLEECYIRPVVFRGYGEMGVHPVNCPVDVAVAAWEWGAYLGAEALEVGVDAGVSTWRRMAPNTMPNMAKAGGNYLNSQLAKMEAVRHGYDEAIMLDYHGYISEGSGENIFLVSEGEIYTPPVSSSLLRGITRDSVIKIARTEGVTVHEEPITREMLYIADEAFFTGTAAEITPIRSVDGIEIGAGRRGPVTKLLQDEFFRIIRAETEDSFGWLTYI

SEQ ID NO: 241 - DNA, 1095 bp, Streptomyces coelicolor
tcacggccggggacgggcctccgccatccgctgctcggcgatccggtcggccgccgcggccggcggaataccgtcctccttcgcacgtgcgaatatggccagcgtggtgtcgtagatcttcgaggccttcgccttgcaccggtcgaagtcgaacccgtgcagctcgtcggcgacctggatgacaccgccggcgttcaccacatagtccggcgcgtagaggatcccgcggtcggcgaggtccttctcgacgcccgggtgggcgagctggttgttggccgcgccgcacaccaccttggcggtcagcaccggcacggtgtcgtcgttcagcgcgccgccgagcgcgcagggcgcgtagatgtccaggttctccacccggatcagcgcgtcggtgtcggcgacggcgaccaccgacgggtgccgctccgtgatcccgcgcaccacgtccttgcgcacgtccgtgacgacgacgtgggcgccctcggcgagcaggtgctcgaccaggtggtggccgaccttgccgacgcccgcgatgccgacggtgcggtcgcgcagcgtcgggtcgccccacaggtgctgggcggcggcccgcatgccctggtagacgccgaaggaggtgagcacggaggagtcgcccgcgccgccgttctccggggaacgcccggtcgtccagcggcactcgcgggccacgacgtccatgtcggcgacgtaggtgccgacgtcgcacgcggtgacgtagcggccgcccagcgaggcgacgaaccggccgtaggcgaggagcagctcctcgctcttgatctgctccggatcgccgatgatcacggccttgccgccaccgtggtccagaccggccatggcgttcttgtacgacatcccgcgggcgaggttcagcgcgtcggcgacggcctccgcctcgctcgcgtacgggtagaagcgggtaccgccgagcgccgggcccagggcggtggagtggagggcgatcacggccttgaggccgctggcacggtcctggcagagcacgacttgctcatgtcccccctgatccgagtggaacagggtgtgcagtacatcagcaggtgcgccgtttacgtcggtcac

SEQ ID NO: 242 - protein, 364 aa, Streptomyces coelicolor
MTDVNGAPADVLHTLFHSDQGGHEQVVLCQDRASGLKAVIALHSTALGPALGGTRFYPYASEAEAVADALNLARGMSYKNAMAGLDHGGGKAVIIGDPEQIKSEELLLAYGRFVASLGGRYVTACDVGTYVADMDVVARECRWTTGRSPENGGAGDSSVLTSFGVYQGMRAAAQHLWGDPTLRDRTVGIAGVGKVGHHLVEHLLAEGAHVVVTDVRKDVVRGITERHPSVVAVADTDALIRVENLDIYAPCALGGALNDDTVPVLTAKVVCGAANNQLAHPGVEKDLADRGILYAPDYVVNAGGVIQVADELHGFDFDRCKAKASKIYDTTLAIFARAKEDGIPPAAAADRIAEQRMAEARPRP

SEQ ID NO: 243 - DNA, 1095 bp, Bacillus subtilis
atggaactttttaaatatatggagaaatacgattacgaacaattggtattctgccaggatgaacaatctggattaaaagcgattatcgccattcatgatacaacgcttggtccggcgcttggcggaacgagaatgtggacatatgaaaatgaagaagcggcaattgaagatgcgctcagattggcaagaggcatgacctataagaacgcggcggcaggcttaaaccttggcggcggaaaaacagtcattatcggcgatccgcgcaaagacaaaaatgaggaaatgttccgcgcgtttggccgctatattcaaggactgaatggcagatacatcacggctgaagatgtgggcacaacggtcgaggatatggatatcattcatgatgagacagactatgtcacagggatttctcctgctttcggctcttctggaaatccgtccccagtcacagcgtacggggtgtacagaggaatgaaggcagcagctaaagctgctttcggaaccgattctcttgaaggaaaaaccattgctgtacagggtgttgggaacgtagcctataacctttgccgccacctgcatgaagaaggagcaaacttaatcgttacggatatcaacaaacaatctgtacagcgtgcagttgaagattttggcgcccgtgcggtagatcctgatgacatttattcacaagactgcgatatttatgcgccgtgtgcccttggtgcgactattaacgacgacaccattaaacagctgaaggcgaaagtgatcgcaggtgcggctaacaaccaattaaaagagacacgccatggtgatcaaattcacgaaatgggcatcgtttatgcaccggattacgtgattaacgcgggcggtgtcatcaacgtggcagatgagctttacggctataatgcagaacgtgcattgaaaaaagttgaaggcatttacggcaatatcgagcgtgtacttgagatttctcagcgtgacggcattcctgcatatttagcggctgaccgcttagcagaggaacggattgaacgcatgcgccgctcaagaagccagtttttgcaaaacggccacagtgtattaagcagacgttaa

SEQ ID NO: 244 - protein, 364 aa, Bacillus subtilis
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 245 - DNA, 1785 bp, Streptomyces viridifaciens
gtgtcaacttcctccgcttcttccgggccggacctccccttcgggcccgaggacacgccatggcagaaggccttcagcaggctgcgggcggtggatggcgtgccgcgcgtcaccgcgccgtccagtgatccgcgtgaggtctacatggacatcccggagatccccttctccaaggtccagatccccccggacggaatggacgagcagcagtacgcagaggccgagagcctcttccgccgctacgtagacgcccagacccgcaacttcgcgggataccaggtcaccagcgacctcgactaccagcacctcagtcactatctcaaccggcatctgaacaacgtcggcgatccctatgagtccagctcctacacgctgaactccaaggtccttgagcgagccgttctcgactacttcgcctccctgtggaacgccaagtggccccatgacgcaagcgatccggaaacgtactggggttacgtgctgaccatgggctccagcgaaggcaacctgtacgggttgtggaacgcacgggactatctgtcgggcaagctgctgcggcgccagcaccgggaggccggcggcgacaaggcctcggtcgtctacacgcaagcgctgcgacacgaagggcagagtccgcatgcctacgagccggtggcgttcttctcgcaggacacgcactactcgctcacgaaggccgtgcgggttctgggcatcgacaccttccacagcatcggcagcagtcggtatccggacgagaacccgctgggccccggcactccgtggccgaccgaagtgccctcggttgacggtgccatcgatgtcgacaaactcgcctcgttggtccgcttcttcgccagcaagggctacccgatactggtcagcctcaactacgggtcaacgttcaagggcgcctacgacgacgtcccggccgtggcacaggccgtgcgggacatctgcacggaatacggtctggatcggcggcgggtataccacgaccgcagtaaggacagtgacttcgacgagcgcagcggcttctggatccacatcgatgccgccctgggggcgggctacgctccctacctgcagatggcccgggatgccggcatggtcgaggaggcgccgcccgttttcgacttccggctcccggaggtgcactcgctgaccatgagcggccacaagtggatgggaacaccgtgggcatgcggtgtctacatgacacggaccgggctgcagatgaccccgccgaagtcgtccgagtacatcggggcggccgacaccaccttcgcgggctcccgcaacggcttctcgtcactgctgctgtgggactacctgtcccggcattcgtatgacgatctggtgcgcctggccgccgactgcgaccggctggccggctacgcccacgaccggttgctgaccttgcaggacaaactcggcatggatctgtgggtcgcccgcagcccgcagtccctcacggtgcgcttccgtcagccatgtgcagacatcgtccgcaagtactcgctgtcgtgtgagacggtctacgaagacaacgagcaacggacctacgtacatctctacgccgttccccacctcactcgggaactcgtggatgagctcgtgcgcgatctgcgccagcccggagccttcaccaacgctggtgcactggagggggaggcctgggccggggtgatcgatgccctcggccgcccggaccccgacggaacctatgccggcgccttgagcgctccggcttccggcccccgctccgaggacggcggcgggagctga

SEQ ID NO: 246 - protein, 594 aa, Streptomyces viridifaciens
MSTSSASSGPDLPFGPEDTPWQKAFSRLRAVDGVPRVTAPSSDPREVYMDIPEIPFSKVQIPPDGMDEQQYAEAESLFRRYVDAQTRNFAGYQVTSDLDYQHLSHYLNRHLNNVGDPYESSSYTLNSKVLERAVLDYFASLWNAKWPHDASDPETYWGYVLTMGSSEGNLYGLWNARDYLSGKLLRRQHREAGGDKASVVYTQALRHEGQSPHAYEPVAFFSQDTHYSLTKAVRVLGIDTFHSIGSSRYPDENPLGPGTPWPTEVPSVDGAIDVDKLASLVRFFASKGYPILVSLNYGSTFKGAYDDVPAVAQAVRDICTEYGLDRRRVYHDRSKDSDFDERSGFWIHIDAALGAGYAPYLQMARDAGMVEEAPPVFDFRLPEVHSLTMSGHKWMGTPWACGVYMTRTGLQMTPPKSSEYIGAADTTFAGSRNGFSSLLLWDYLSRHSYDDLVRLAADCDRLAGYAHDRLLTLQDKLGMDLWVARSPQSLTVRFRQPCADIVRKYSLSCETVYEDNEQRTYVHLYAVPHLTRELVDELVRDLRQPGAFTNAGALEGEAWAGVIDALGRPDPDGTYAGALSAPASGPRSEDGGGS

SEQ ID NO: 247 - DNA, 1323 bp, Alcaligenes denitrificans
atgagcgctgccaaactgcccgacctgtcccacctctggatgccctttaccgccaaccggcagttcaaggcgaacccccgcctgctggcctcggccaagggcatgtactacacgtctttcgacggccgccagatcctggacggcacggccggcctgtggtgcgtgaacgccggccactgccgcgaagaaatcgtctccgccatcgccagccaggccggcgtcatggactacgcgccggggttccagctcggccacccgctggccttcgaggccgccaccgccgtggccggcctgatgccgcagggcctggaccgcgtgttcttcaccaattcgggctccgaatcggtggacaccgcgctgaagatcgccctggcctaccaccgcgcgcgcggcgaggcgcagcgcacccgcctcatcgggcgcgagcgcggctaccacggcgtgggcttcggcggcatttccgtgggcggcatctcgcccaaccgcaagaccttctccggcgcgctgctgccggccgtggaccacctgccgcacacccacagcctggaacacaacgccttcacgcgcggccagcccgagtggggcgcgcacctggccgacgagttggaacgcatcatcgccctgcacgacgcctccaccatcgcggccgtgatcgtcgagcccatggccggctccaccggcgtgctcgtcccgcccaagggctatctcgaaaaactgcgcgaaatcaccgcccgccacggcattctgctgatcttcgacgaagtcatcaccgcgtacggccgcctgggcgaggccaccgccgcggcctatttcggcgtaacgcccgacctcatcaccatggccaagggcgtgagcaacgccgccgttccggccggcgccgtcgcggtgcgccgcgaagtgcatgacgccatcgtcaacggaccgcaaggcggcatcgagttcttccacggctacacctactcggcccacccgctggccgccgccgccgtgctcgccacgctggacatctaccgccgcgaagacctgttcgcccgcgcccgcaagctgtcggccgcgttcgaggaagccgcccacagcctcaagggcgcgccgcacgtcatcgacgtgcgcaacatcggcctggtggccggcatcgagctgtcgccgcgcgaaggcgccccgggcgcgcgcgccgccgaagccttccagaaatgcttcgacaccggcctcatggtgcgctacacgggcgacatcctcgcggtgtcgcctccgctcatcgtcgacgaaaaccagatcggccagatcttcgagggcatcggcaaggtgctcaaggaagtggcttag

SEQ ID NO: 248 - protein, 440 aa, omega-amino acid:pyruvate transaminase
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 249 - DNA, 1332 bp, Ralstonia eutropha
atggacgccgcgaagaccgtgattcccgatctcgatgccctgtggatgccctttaccgcgaaccgccagtacaaggcggcgccgcgcctgctggcctcggccagcggcatgtactacaccacccacgacggacgccagatcctcgacggttgcgcgggcctctggtgcgtagcggccggccactgccgcaaggagattgccgaggccgtggcccgccaggccgccacgctcgactacgcgccgccgttccagatgggccatccgctgtcgttcgaagccgccaccaaggtggccgcgatcatgccgcagggactggaccgcatcttcttcacgaattccggttcggaatcggtggacaccgcgctgaagattgcgctggcctaccaccgtgcgcgcggcgagggccagcgcacccgcttcatcgggcgcgaacgcggttaccacggcgtgggctttggcggcatggctgtcggtggcatcgggccgaaccgcaaggcgttctcggccaacctgatgccgggcaccgaccatctgccggcgacgctgaatatcgccgaagcggcgttctccaagggtcagccgacatggggcgcgcaccttgccgacgaactcgagcgcatcgtcgcgctgcatgatccgtccacgattgccgccgtcatcgtggaaccgctggcgggctccgccggggtgctggtgccgccggtcggctacctcgacaagctgcgcgagatcacgaccaagcacggcatcctgctgatcttcgacgaggtcatcacggcctttggtcgcctgggtaccgccaccgcggcggaacgcttcaaggtcacgccggacctgatcaccatggccaaggccatcaacaacgccgccgtgccgatgggtgccgtggccgtgcgccgcgaagtccatgacaccgtggtcaactcggccgcgccgggcgcgatcgaactcgcgcatggctacacctactcgggccacccgctggccgccgccgctgccatcgccacgctggacctgtatcagcgcgagaacctgttcggccgtgccgcggagctgtcgccggtgttcgaagcggccgttcacagcgtacgcagcgcgccgcatgtgaaggacatccgcaacctcggcatggtggccggcatcgagctggagccgcgtccgggccagcccggcgcacgcgcctacgaagccttcctcaaatgccttgagcgtggcgtgctggtgcgctacaccggcgatatcctcgcgttctcgccgccgctgatcatcagcgaggcgcagattgccgagctgttcgatacggtcaagcaggccttgcaggaagtgcagtaa

SEQ ID NO: 250 - protein, 443 aa, Ralstonia eutropha
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 251 - DNA, 1341 bp, Shewanella oneidensis
atggccgactcacccaacaacctcgctcacgaacatccttcacttgaacactattggatgccttttaccgccaatcgccaattcaaagcgagccctcgtttactcgcccaagctgaaggtatgtattacacagatatcaatggcaacaaggtattagactctacagcgggcttatggtgttgtaatgctggccatggtcgccgtgagatcagtgaagccgtcagcaaacaaattcggcagatggattacgctccctccttccaaatgggccatcccatcgcttttgaactggccgaacgtttaaccgaactcagcccagaaggactcaacaaagtattctttaccaactcaggctctgagtcggttgataccgcgctaaaaatggctctttgctaccatagagccaatggccaagcgtcacgcacccgctttattggccgtgaaatgggttaccatggcgtaggatttggtgggatctcggtgggtggtttaagcaataaccgtaaagccttcagcggccagctattgcaaggcgtggatcacctgccccacaccttagacattcaacatgccgcctttagtcgtggcttaccgagcctcggtgctgaaaaagctgaggtattagaacaattagtcacactccatggcgccgaaaatattgccgccgttattgttgaacccatgtcaggttctgcaggggtaattttaccacctcaaggctacttaaaacgcttacgtgaaatcactaaaaaacacggcatcttattgattttcgatgaagtcattaccgcatttggccgtgtaggtgcagcattcgccagccaacgttggggcgttattccagacataatcaccacggctaaagccattaataatggcgccatccccatgggcgcagtgtttgtacaggattatatccacgatacttgcatgcaagggccaaccgaactgattgaatttttccacggttatacctattcgggccacccagtcgccgcagcagcagcactcgccacgctctccatctaccaaaacgagcaactgtttgagcgcagttttgagcttgagcggtatttcgaagaagccgttcatagcctcaaagggttaccgaatgtgattgatattcgcaacaccggattagtcgcgggtttccagctagcaccgaatagccaaggtgttggtaaacgcggatacagcgtgttcgagcattgtttccatcaaggcacactcgtgcgggcaacgggcgatattatcgccatgtccccaccactcattgttgagaaacatcagattgaccaaatggtaaatagccttagcgatgcaattcacgccgttggatga

SEQ ID NO: 252 - protein, 446 aa, beta alanine-pyruvate transaminase
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 253 - DNA, 1347 bp, Pseudomonas putida
atgaacatgcccgaaactggtcctgccggtatcgccagccagctcaagctggacgcccactggatgccctacaccgccaaccgcaacttccagcgcgacccacgcctgatcgtggcggccgaaggcaactacctggtcgatgaccacgggcgcaagatcttcgacgccctgtccggcctgtggacctgcggcgcagggcacactcgcaaggaaatcgctgacgcggtgacccgtcaactgagtacgctggactactccccagcgttccagttcggccacccgctgtcgttccagctggcggaaaagatcgccgagctggttccgggcaatctgaatcacgtcttctataccaactccggttccgagtgcgccgataccgcactgaagatggtgcgtgcctactggcgcctgaaaggccaggcaaccaagaccaagatcatcggccgtgcccgtggttaccatggcgtgaacatcgccggtaccagcctgggtggcgtcaacggtaaccgcaagatgtttggccagctgctggacgtcgaccacctgcctcacactgtattgccggtgaacgccttctcgaaaggcttgccggaagagggcggtatcgcgctggctgacgaaatgctcaagctgatcgagctgcacgatgcctccaacatcgcagcagtcatcgtcgagccgctggccggttcggccggtgtgctgccgccgccaaagggttacctgaagcgcctgcgtgaaatctgcacccagcacaacattctgctgatcttcgacgaagtgatcacaggcttcggccgcatgggcgcgatgaccggctcggaagccttcggcgttaccccggacctgatgtgcatcgccaagcaggtgaccaacggcgccatcccgatgggcgcagtgattgccagcagcgagatctaccagaccttcatgaaccagccgaccccggaatacgccgtggaattcccacacggctacacctattcggcgcacccggtagcctgtgccgccggtctcgccgcgctggacctgctgcagaaggaaaacctggtgcagtccgcggctgaactggcgccgcatttcgagaagctgctgcacggcgtgaagggcaccaagaatatcgtcgatatccgcaactacggcctggccggcgccatccagatcgccgcccgtgacggtgatgccatcgttcgcccttacgaagcggccatgaagctgtggaaagcgggcttctatgtacgctttggtggcgacaccctgcagttcggcccaaccttcaataccaagccgcaggaactggaccgcttgttcgatgctgttggcgaaaccctgaacctgatcgactga

SEQ ID NO: 254 - protein, 448 aa, Pseudomonas putida
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 255 - DNA, 1701 bp, Streptomyces cinnamonensis
atggacgctgacgcgatcgaggaaggccgccgacgctggcaggcccgttacgacaaggcccgcaagcgcgacgcggacttcaccacgctctccggggaccccgtcgaccccgtctacggcccccggcccggggacacgtacgacgggttcgagcggatcggctggccgggggagtaccccttcacccgcgggctctacgccaccgggtaccgcggccgcacctggaccatccgccagttcgccggcttcggcaacgccgagcagacgaacgagcgctacaagatgatcctggccaacggcggcggcggcctctccgtcgccttcgacatgccgaccctcatgggccgcgactccgacgacccgcgctcgctcggcgaggtcggccactgcggtgtcgccatcgactccgccgccgacatggaggtcctcttcaaggacatcccgctcggcgacgtcacgacgtccatgaccatcagcgggcccgccgtgcccgtcttctgcatgtacctcgtcgcggccgagcgccagggcgtcgacccggccgtcctcaacggcacgctgcagaccgacatcttcaaggagtacatcgcccagaaggagtggctcttccagcccgagccgcacctgcgcctcatcggcgacctgatggagcactgcgcgcgcgacatccccgcgtacaagccgctctcggtctccggctaccacatccgcgaggccggggcgacggccgcgcaggagctcgcgtacaccctcgcggacggcttcgggtacgtggaactgggcctctcgcgcggcctggacgtggacgtcttcgcgcccggcctctccttcttcttcgacgcgcacgtcgacttcttcgaggagatcgcgaagttccgcgccgcacgccgcatctgggcgcgctggctccgggacgagtacggagcgaagaccgagaaggcacagtggctgcgcttccacacgcagaccgcgggggtctcgctcacggcccagcagccgtacaacaacgtggtgcggacggcggtggaggccctcgccgcggtgctcggcggcacgaactccctgcacaccaacgctctcgacgagacccttgccctccccagcgagcaggccgcggagatcgcgctgcgcacccagcaggtgctgatggaggagaccggcgtcgccaacgtcgcggacccgctgggcggctcctggtacatcgagcagctcaccgaccgcatcgaggccgacgccgagaagatcttcgagcagatcagggagcgggggcggcgggcctgccccgacgggcagcacccgatcgggccgatcacctccggcatcctgcgcggcatcgaggacggctggttcaccggcgagatcgccgagtccgccttccagtaccagcggtccctggagaagggcgacaagcgggtcgtcggcgtcaactgcctcgaaggctccgtcaccggcgacctggagatcctgcgcgtcagccacgaggtcgagcgcgagcaggtgcgggagcttgcggggcgcaaggggcggcgtgacgatgcgcgggtgcgggcctcgctcgacgcgatgctcgccgctgcgcgggacgggtcgaacatgattgcccccatgctggaggcggtgcgggccgaggcgaccctcggggagatctgcggggtgcttcgcgatgagtggggggtctacgtggagccgcccgggttctga

SEQ ID NO: 256 - protein, 566 aa, Streptomyces cinnamonensis
MDADAIEEGRRRWQARYDKARKRDADFTTLSGDPVDPVYGPRPGDTYDGFERIGWPGEYPFTRGLYATGYRGRTWTIRQFAGFGNAEQTNERYKMILANGGGGLSVAFDMPTLMGRDSDDPRSLGEVGHCGVAIDSAADMEVLFKDIPLGDVTTSMTISGPAVPVFCMYLVAAERQGVDPAVLNGTLQTDIFKEYIAQKEWLFQPEPHLRLIGDLMEHCARDIPAYKPLSVSGYHIREAGATAAQELAYTLADGFGYVELGLSRGLDVDVFAPGLSFFFDAHVDFFEEIAKFRAARRIWARWLRDEYGAKTEKAQWLRFHTQTAGVSLTAQQPYNNVVRTAVEALAAVLGGTNSLHTNALDETLALPSEQAAEIALRTQQVLMEETGVANVADPLGGSWYIEQLTDRIEADAEKIFEQIRERGRRACPDGQHPIGPITSGILRGIEDGWFTGEIAESAFQYQRSLEKGDKRVVGVNCLEGSVTGDLEILRVSHEVEREQVRELAGRKGRRDDARVRASLDAMLAAARDGSNMIAPMLEAVRAEATLGEICGVLRDEWGVYVEPPGF

SEQ ID NO: 257 - DNA, 411 bp, Streptomyces cinnamonensis
atgggtgtggcagccgggccgatccgcgtggtggtcgccaagccggggctcgacgggcacgatcgcggggccaaggtgatcgcgcgggcgttgcgtgacgcgggtatggaggtcatctacaccgggctgcaccagacgcccgagcaggtggtggacaccgcgatccaggaggacgccgacgcgatcggcctctccatcctctccggagcgcacaacacgctgttcgcgcgcgtgttggagctcttgaaggagcgggacgcggaggacatcaaggtgtttggtggcggcatcatcccggaggcggacatcgcgccgctgaaggagaagggcgtcgcggagatcttcacgcccggggccaccaccacgtcgatcgtggagtgggttcgggggaacgtgcgacaggccgtctga

SEQ ID NO: 258 - protein, 136 aa, Streptomyces cinnamonensis
MGVAAGPIRVVVAKPGLDGHDRGAKVIARALRDAGMEVIYTGLHQTPEQVVDTAIQEDADAIGLSILSGAHNTLFARVLELLKERDAEDIKVFGGGIIPEADIAPLKEKGVAEIFTPGATTTSIVEWVRGNVRQAV

SEQ ID NO: 259 - DNA, 1701 bp, Streptomyces coelicolor
atggacgctcatgccatagaggagggccgccttcgctggcaggcccggtacgacgcggcgcgcaagcgcgacgcggacttcaccacgctctccggagaccccgtggagccggtgtacgggccccgccccggggacgagtacgagggcttcgagcggatcggctggccgggcgagtaccccttcacccgcggcctgtatccgaccgggtaccgggggcgtacgtggaccatccggcagttcgccgggttcggcaacgccgagcagaccaacgagcgctacaagatgatcctccgcaacggcggcggcgggctctcggtcgccttcgacatgccgaccctgatgggccgcgactccgacgacccgcgctcgctgggcgaggtcgggcactgcggggtggccatcgactcggccgccgacatggaagtgctgttcaaggacatcccgctcggggacgtgacgacctccatgacgatcagcgggcccgccgtgcccgtgttctgcatgtacctcgtcgccgccgagcgccagggcgtcgacgcatccgtgctcaacggcacgctgcagaccgacatcttcaaggagtacatcgcccagaaggagtggctcttccagcccgagccccacctccggctcatcggcgacctcatggagtactgcgcggccggcatccccgcctacaagccgctctccgtctccggctaccacatccgcgaggcgggcgcgacggccgcgcaggagctggcgtacacgctcgccgacggcttcggatacgtggagctgggcctcagccgcgggctcgacgtggacgtcttcgcgcccggcctctccttcttcttcgacgcgcacctcgacttcttcgaggagatcgccaagttccgcgcggcccgcaggatctgggcccgctggatgcgcgacgtgtacggcgcgcggaccgacaaggcccagtggctgcggttccacacccagaccgccggagtctcgctcaccgcgcagcagccgtacaacaacgtcgtacgcaccgcggtggaggcgctggcggccgtgctcggcggcaccaactccctgcacaccaacgcgctcgacgagaccctcgccctgcccagcgagcaggccgccgagatcgccctgcgcacccagcaggtgctgatggaggagaccggcgtcgccaacgtcgccgacccgctgggcggttcctggttcatcgagcagctgaccgaccgcatcgaggccgacgccgagaagatcttcgagcagatcaaggagcgggggctgcgcgcccaccccgacgggcagcaccccgtcggaccgatcacctccggcctgctgcgcggcatcgaggacggctggttcaccggcgagatcgccgagtccgccttccgctaccagcagtccttggagaaggacgacaagaaggtggtcggcgtcaacgtccacaccggctccgtcaccggcgacctggagatcctgcgggtcagccacgaggtcgagcgcgagcaggtgcgggtcctgggcgagcgcaaggacgcccgggacgacgccgccgtgcgcggcgccctggacgccatgctggccgcggcccgctccggcggcaacatgatcgggccgatgctggacgcggtgcgcgcggaggcgacgctgggcgagatctgcggtgtgctgcgcgacgagtggggggtgtacacggaaccggcggggttctga

SEQ ID NO: 260 - protein, 566 aa, Streptomyces coelicolor
MDAHAIEEGRLRWQARYDAARKRDADFTTLSGDPVEPVYGPRPGDEYEGFERIGWPGEYPFTRGLYPTGYRGRTWTIRQFAGFGNAEQTNERYKMILRNGGGGLSVAFDMPTLMGRDSDDPRSLGEVGHCGVAIDSAADMEVLFKDIPLGDVTTSMTISGPAVPVFCMYLVAAERQGVDASVLNGTLQTDIFKEYIAQKEWLFQPEPHLRLIGDLMEYCAAGIPAYKPLSVSGYHIREAGATAAQELAYTLADGFGYVELGLSRGLDVDVFAPGLSFFFDAHLDFFEEIAKFRAARRIWARWMRDVYGARTDKAQWLRFHTQTAGVSLTAQQPYNNVVRTAVEALAAVLGGTNSLHTNALDETLALPSEQAAEIALRTQQVLMEETGVANVADPLGGSWFIEQLTDRIEADAEKIFEQIKERGLRAHPDGQHPVGPITSGLLRGIEDGWFTGEIAESAFRYQQSLEKDDKKVVGVNVHTGSVTGDLEILRVSHEVEREQVRVLGERKDARDDAAVRGALDAMLAAARSGGNMIGPMLDAVRAEATLGEICGVLRDEWGVYTEPAGF

SEQ ID NO: 261 - DNA, 417 bp, Streptomyces coelicolor
atgggtgtggcagccggtccgatccgcgtggtggtggccaagccggggctcgacggccacgatcgcggggccaaggtgatcgcgagggccctgcgtgacgccggtatggaggtgatctacaccgggctccaccagacgcccgagcagatcgtcgacaccgcgatccaggaggacgccgacgcgatcgggctgtccatcctctccggtgcgcacaacacgctcttcgccgccgtgatcgagctgctccgggagcgggacgccgcggacatcctggtcttcggcggcgggatcatccccgaggcggacatcgccccgctgaaggagaagggcgtcgcggagatcttcacgcccggcgccaccacggcgtccatcgtggactgggtccgggcgaacgtgcgggagcccgcgggagcatag

SEQ ID NO: 262 - protein, 138 aa, Streptomyces coelicolor
MGVAAGPIRVVVAKPGLDGHDRGAKVIARALRDAGMEVIYTGLHQTPEQIVDTAIQEDADAIGLSILSGAHNTLFAAVIELLRERDAADILVFGGGIIPEADIAPLKEKGVAEIFTPGATTASIVDWVRANVREPAGA

SEQ ID NO: 263 - DNA, 1701 bp, Streptomyces avermitilis
tcagaaaccggcgggctccgtgtagaccccccactcctcccggaggacatcgcagatctcgcccagcgtggcctccgcgcggaccgcgtccagcatcggggcgatcatgttcgacccgtcgcgcgcggcggcgagcatcgcgtccagggccgcggttacggccgtgtcgtcgcgccccgacttccgctcgcccagcacccgcacctgctcgcgctccacctcgtggctgacgcgcaggatctccaggtcgcccgtcacggacccgtggtggacgttgacgccgacgacccgcttgtcgcccttctccagcgcctgctggtactggaaggccgactcggcgatctccccggtgaaccagccgtcctcgatgccgcgcaggatgccggaggtgatgggcccgatcgggtgccgcccgtccgggtgggcccgcagcccgcgctccctgatctgttcgaagatcttctcggcgtcggcctcgatccggtcggtcagctgctccacgtaccaggaaccgcccagcggatcggccacgttggcgacgcccgtctcctccatcagcacctgctgggtgcgcagggcgatctcggccgcctgctcggacggcagggcgagggtctcgtcgagggcgttggtgtgcagcgagttcgtcccgccgagcaccgcggcgagggcctccacggccgtccgtacgacgttgttgtacggctgctgcgcggtgagcgagacgcccgcggtctgggtgtggaagcgcagccactgcgccttctccgacttcgccccgtacacgtcccgcagccagcgcgcccagatgcgccgcgccgcacggaacttggcgatctcctcgaagaagtcgacgtgcgcgtcgaagaagaaggagagcccgggcgcgaacacgtccacgtccaggccgcggctcagccccagctccacgtatccgaaaccgtcggcgagggtgtacgccagctcctgggcggccgtggcaccggcctcccggatgtggtacccggagacggacagcggcttgtacgcggggatcttcgaggcgcagtgctccatcaggtcgccgatgagccgcagatggggctcgggctggaagagccactccttctgcgcgatgtactccttgaagatgtcggtctggagggtgccgttgaggacggaggggtcgacgccctgccgctcggccgcgaccaggtacatgcagaagacgggcacggcgggcccgctgatcgtcatcgacgtcgtcacgtcacccagcgggatgtccttgaacaggacctccatgtcggccgccgagtcgatcgcgaccccgcagtgcccgacctcgccgagcgcgcggcggtcgtcggagtcgcgccccatgagcgtcggcatgtcgaaggccacggacagcccaccgccgccgttggcgaggatcttcttgtagcgctcgttggtctgctcggcgttgccgaacccggcgaactgccggatggtccaggtccggccccggtagccggtcggatacagaccgcgcgtgaaggggtactcacccggccagccgatccgctcgaaaccctcgtacgcgtccccgggccggggcccgtacgccggctccacgggatcgccggagagcgtggtgaaatcggcctcgcgcttgcgtgaggcgtcgtagcgggcctgccagcgtcggcggccttcctcgatggcgtcagcgtccat

SEQ ID NO: 264 - protein, 566 aa, Streptomyces avermitilis
MDADAIEEGRRRWQARYDASRKREADFTTLSGDPVEPAYGPRPGDAYEGFERIGWPGEYPFTRGLYPTGYRGRTWTIRQFAGFGNAEQTNERYKKILANGGGGLSVAFDMPTLMGRDSDDRRALGEVGHCGVAIDSAADMEVLFKDIPLGDVTTSMTISGPAVPVFCMYLVAAERQGVDPSVLNGTLQTDIFKEYIAQKEWLFQPEPHLRLIGDLMEHCASKIPAYKPLSVSGYHIREAGATAAQELAYTLADGFGYVELGLSRGLDVDVFAPGLSFFFDAHVDFFEEIAKFRAARRIWARWLRDVYGAKSEKAQWLRFHTQTAGVSLTAQQPYNNVVRTAVEALAAVLGGTNSLHTNALDETLALPSEQAAEIALRTQQVLMEETGVANVADPLGGSWYVEQLTDRIEADAEKIFEQIRERGLRAHPDGRHPIGPITSGILRGIEDGWFTGEIAESAFQYQQALEKGDKRVVGVNVHHGSVTGDLEILRVSHEVEREQVRVLGERKSGRDDTAVTAALDAMLAAARDGSNMIAPMLDAVRAEATLGEICDVLREEWGVYTEPAGF

SEQ ID NO: 265 - DNA, 417 bp, Streptomyces avermitilis
ctacgccccggcaggctgccgcacgttcgcccgcacccactccacgatcgacgccgtggtcgcccccggagtgaagatctccgcgacacccttctccttcagcggcgcgatgtccgcctcggggatgatgccgccaccgaacaccttgatgtcctcggcatcgcgctccttgagcagatcgatgaccgccgcgaacaacgtgttgtgcgccccggacaggatcgacagcccgatcgcgtcggcgtcctcctggatggccgtgcccacgatctgctccggcgtctggtgcagccccgtgtaaatgacctccataccggcatcgcgcagcgcccgcgcgatcaccttggccccgcgatcgtggccatcgagccccggcttggccaccaccacgcggatcggaccggctgccacacccat

SEQ ID NO: 266 - protein, 138 aa, Streptomyces avermitilis
MGVAAGPIRVVVAKPGLDGHDRGAKVIARALRDAGMEVIYTGLHQTPEQIVGTAIQEDADAIGLSILSGAHNTLFAAVIDLLKERDAEDIKVFGGGIIPEADIAPLKEKGVAEIFTPGATTASIVEWVRANVRQPAGA

SEQ ID NO: 267 - DNA, 2910 bp, Staphylococcus aureus
gatcaatttcttttaagtaatctaaatccccattttttaatttctttttagcctctttaaataatcctgaataaactaatacctgtttacctttaagtgatttataaaatgcatcaaagactttttgatttatttattaaataatcactatctttaccagaatacttagccatttcatataattctttattattattttgtcttattttttgaacttgaacttgtgttatttctgaaatgcccgttacatcacgccataaatctaaccattcttgttggctaatataatatcttttatctgtgaaatacgatttatttactgcaattaacacatgaaaatgaggattataatcatctctttttttattatatgtaatctctaacttacgaacatatccctttataacactacctactttttttctctttataagttttctaaaagaattattataacgttttatttcattttctaattcatcactcattacattaggtgtagtcaaagttaaaaagataaactcctttttctcttgctgcttaatatattgcatcatcaaagataaacccaatgcatcttttctagcttttctccaagcacagacaggacaaaatcgatttttacaagaattagctttatataatttctgtttttctaaagttttatcagctacaaaagacagaaatgtattgcaatcttcaactaaatccatttgattctctccaatatgacgtttaataaatttctgaaatacttgatttctttgttttttctcagtatacttttccatgttataacacataaaaacaacttagttttcacaaactatgacaataaaaaaagttgctttttcccctttctatgtatgttttttactagtcatttaaaacgatacattaataggtacgaaaaagcaactttttttgcgcttaaaaccagtcataccaataacttaagggtaactagcctcgccggcaatagttacccttattatcaagataagaaagaaaaggatttttcgctacgctcaaatcctttaaaaaaacacaaaagaccacattttttaatgtggtctttattcttcaactaaagcacccattagttcaacaaacgaaaattggataaagtgggatatttttaaaatatatatttatgttacagtaatattgacttttaaaaaaggattgattctaatgaagaaagcagacaagtaagcctcctaaattcactttagataaaaatttaggaggcatatcaaatgaactttaataaaattgatttagacaattggaagagaaaagagatatttaatcattatttgaaccaacaaacgacttttagtataaccacagaaattgatattagtgttttataccgaaacataaaacaagaaggatataaattttaccctgcatttattttcttagtgacaagggtgataaactcaaatacagcttttagaactggttacaatagcgacggagagttaggttattgggataagttagagccactttatacaatttttgatggtgtatctaaaacattctctggtatttggactcctgtaaagaatgacttcaaagagttttatgatttatacctttctgatgtagagaaatataatggttcggggaaattgtttcccaaaacacctatacctgaaaatgctttttctctttctattattccatggacttcatttactgggtttaacttaaatatcaataataatagtaattaccttctacccattattacagcaggaaaattcattaataaaggtaattcaatatatttaccgctatctttacaggtacatcattctgtttgtgatggttatcatgcaggattgtttatgaactctattcaggaattgtcagataggcctaatgactggcttttataatatgagataatgccgactgtactttttacagtcggttttctaatgtcactaacctgccccgttagttgaagaaggtttttatattacagctccagatccatatccttctttttctgaaccgacttctcctttttcgcttctttattccaattgctttattgacgttgagcctcggaacccttaacaatcccaaaacttgtcgaatggtcggcttaatagctcacgctatgccgacattcgtctgcaagtttagttaagggttcttctcaacgcacaataaattttctcggcataaatgcgtggtctaatttttatttttaataaccttgatagcaaaaaatgccattccaatacaaaaccacatacctataatcgataaccacataacagtcataaaaccactcctttttaacaaactttatcacaagaaatatttaaattttaaatgcctttattttgaattttaaggggcattttaaagatttaggggtaaatcatatagttttatgcctaaaaacctacagaagcttttaaaaagcaaatatgagccaaataaatatattctaattctacaaacaaaaatttgagcaaattcagtgtcgattttttaagacactgcccagttacatgcaaattaaaattttcatgattttttatagttcctaacagggttaaaatttgtataacgaaagtataatgtttatataacgttagtataataaagcattttaacattatacttttgataatcgtttatcgtcgtcatcacaataacttttaaaatactcgtgcataattcacgctgacctcccaataactacatggtgttatcgggaggtcagctgttagcacttatattttgttattgttcttcctcgatttcgtctatcattttgtgattaatttctcttttttcttgttctgttaagtcataaagttcactagctaaatactctttttgtttccaaatataaaaaatttgatagatatattacggttg

SEQ ID NO: 268 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 269 - protein, 338 aa, Pseudomonas fluorescens
MKVFYDKDCDLSIIQGKKVAIIGFGSQGHAQACNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAAVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 270 - protein, 338 aa, artificial sequence
  synthetic construct mutant ilcV
MKVFYDKDCDLSIIQGKKVAIIGFGSQGHAQACNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 271 - protein, 338 aa, artificial sequence
  synthetic construct mutant ilcV
MKVFYDKDCDLSIIQGKKVAIIGFGSQGHAQALNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 272 - protein, 338 aa, artificial sequence
  synthetic construct mutant ilcV
MKVFYDKDCDLSIIQGKKVAIIGFGSQGHAQALNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 273 - protein, 338 aa, Artificial sequence
  synthetic construct mutant ilcV
MKVFYDKDCDLSIIQGKKVAIIGFGSQGHAQALNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAAVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 274 - protein, 338 aa, Artificial sequence
  synthetic construct mutant ilcV
MKVFYDKDCDLSIIQGKKVAIIGYGSQGHAQALNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAAVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 275 - protein, 338 aa, artificial sequence
  mutant KARI 3361G8
MKVFYDKDCDLSIIQGKKVAIIGYGSQGHAQALNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 276 - protein, 338 aa, artificial sequence
  KARI mutant 2H10
MKVFYDKDCDLSIIQGKKVAIIGFGSQGHAQALNLKDSGVDVTVGLYKGAADIAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 277 - protein, 338 aa, artificial sequence
  KARI mutant 1D2
MKVFYDKDCDLSIIQGKKVAIIGFGSQGHAQACNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 278 - protein, 338 aa, artificial sequence
  KARI mutant 3F12
MKVFYDKDCDLSIIQGKKVAIIGFGSQGHAQALNLKDSGVDVTVGLYKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 279 - protein, 338 aa, artificial sequence
  mutant JB1C6
MKVFYDKDCDLSIIQGKKVAIIGFGSQGHAQALNLKDSGVDVTVGLHKGDAYYAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 280 - protein, 338 aa, artificial sequence
  mutant 16445E4
MKVFYDKDCDLSIIQGKKVAIIGYGSQGHAQALNLKDSGVDVTVGLPKGVADGAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 281 - protein, 338 aa, artificial sequence
  mutant 16468D7
MKVFYDKDCDLSIIQGKKVAIIGFGSQGHAQALNLKDSGVDVTVGLTKGIADRAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 282 - protein, 338 aa, artificial sequence
  mutant 16469F3
MKVFYDKDCDLSIIQGKKVAIIGYGSQGHAQALNLKDSGVDVTVGLEKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 283 - protein, 338 aa, artificial sequence
  mutant JEA1
MKVFYDKDCDLSIIQGKKVAIIGFGSQGHAQALNLKDSGVDVTVGLPKGFADVAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 284 - protein, 338 aa, artificial sequence
  mutant JEG2
MKVFYDKDCDLSIIQGKKVAIIGFGSQGHAQALNLKDSGVDVTVGLFKGAADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 285 - protein, 338 aa, artificial sequence
  mutant JEG4
MKVFYDKDCDLSIIQGKKVAIIGFGSQGHAQALNLKDSGVDVTVGLNKGNADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 286 - protein, 338 aa, artificial sequence
  mutant JEA7
MKVFYDKDCDLSIIQGKKVAIIGFGSQGHAQALNLKDSGVDVTVGLPKGNADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 287 - protein, 338 aa, artificial sequence
  mutant JED1
MKVFYDKDCDLSIIQGKKVAIIGYGSQGHAQALNLKDSGVDVTVGLNKGNADAAKAEAHGFKVTDVAAAVAGADLVMILIPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 288 - protein, 338 aa, artificial sequence
  mutant 3361E1
MKVFYDKDCDLSIIQGKKVAIIGFGSQGHAQACNLKDSGVDVTVGLYKGAADAAKAEAHGFKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 289 - protein, 338 aa, artificial sequence
  mutant C2F6
MKVFYDKDCDLSIIQGKKVAIIGYGSQGHAQACNLKDSGVDVTVGLPKGVADWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 290 - protein, 338 aa, artificial sequence
  mutant C3B11
MKVFYDKDCDLSIIQGKKVAIIGYGSQGHAQACNLKDSGVDVTVGLFKGAADWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 291 - protein, 338 aa, artificial sequence
  mutant C4D12
MKVFYDKDCDLSIIQGKKVAIIGYGSQGHAQACNLKDSGVDVTVGLCKGWAGWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 292 - protein, 338 aa, artificial sequence
  mutant SE!
MKVFYDKDCDLSIIQGKKVAIIGYGSQGHAQACNLKDSGVDVTVGLAKGWAGWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 293 - protein, 338 aa, artificial sequence
  mutant SE2
MKVFYDKDCDLSIIQGKKVAIIGYGSQGHAQACNLKDSGVDVTVGLPKGEAAWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 294 - protein, 338 aa, artificial sequence
  mutant SB3
MKVFYDKDCDLSIIQGKKVAIIGYGSQGHAQACNLKDSGVDVTVGLGKGWAGWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 295 - protein, 338 aa, artificial sequence
  mutant SD3
MKVFYDKDCDLSIIQGKKVAIIGYGSQGHAQACNLKDSGVDVTVGLLKGWAGWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 296 - protein, 338 aa, artificial sequence
  mutant 9650E5
MKVFYDKDCDLSIIQGKKVAIIGYGSQGHAQACNLKDSGVDVTVGLNKGWAGHAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 297 - protein, 338 aa, artificial sequence
  mutant 9667A11
MKVFYDKDCDLSIIQGKKVAIIGYGSQGHAQACNLKDSGVDVTVGLNKGNAGHAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 298 - protein, 338 aa, artificial sequence
  mutant 9862B9
MKVFYDKDCDLSIIQGKKVAIIGYGSQGHAQACNLKDSGVDVTVGLDKGWAGWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 299 - protein, 338 aa, artificial sequence
  mutant 9875B9
MKVFYDKDCDLSIIQGKKVAIIGYGSQGHAQACNLKDSGVDVTVGLNKGNADWAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 300 - protein, 338 aa, artificial sequence
  mutant 11461D8
MKVFYDKDCDLSIIQGKKVAIIGYGSQGHAQACNLKDSGVDVTVGLFKGAADAAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 301 - protein, 338 aa, artificial sequence
  mutant 11463
MKVFYDKDCDLSIIQGKKVAIIGYGSQGHAQACNLKDSGVDVTVGLPKGFADVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 302 - protein, 338 aa, artificial sequence
  mutant 1151B4
MKVFYDKDCDLSIIQGKKVAIIGYGSQGHAQACNLKDSGVDVTVGLNKGNADAAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDVSGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 303 - DNA, 1692 bp, Saccharomyces cerevisiae
  CDS (1)..(1692)
atgtctgaaattactttgggtaaatatttgttcgaaagattaaagcaagtcaacgttaacaccgttttcggtttgccaggtgacttcaacttgtccttgttggacaagatctacgaagttgaaggtatgagatgggctggtaacgccaacgaattgaacgctgcttacgccgctgatggttacgctcgtatcaagggtatgtcttgtatcatcaccaccttcggtgtcggtgaattgtctgctttgaacggtattgccggttcttacgctgaacacgtcggtgttttgcacgttgttggtgtcccatccatctctgctcaagctaagcaattgttgttgcaccacaccttgggtaacggtgacttcactgttttccacagaatgtctgccaacatttctgaaaccactgctatgatcactgacattgctaccgccccagctgaaattgacagatgtatcagaaccacttacgtcacccaaagaccagtctacttaggtttgccagctaacttggtcgacttgaacgtcccagctaagttgttgcaaactccaattgacatgtctttgaagccaaacgatgctgaatccgaaaaggaagtcattgacaccatcttggctttggtcaaggatgctaagaacccagttatcttggctgatgcttgttgttccagacacgacgtcaaggctgaaactaagaagttgattgacttgactcaattcccagctttcgtcaccccaatgggtaagggttccattgacgaacaacacccaagatacggtggtgtttacgtcggtaccttgtccaagccagaagttaaggaagccgttgaatctgctgacttgattttgtctgtcggtgctttgttgtctgatttcaacaccggttctttctcttactcttacaagaccaagaacattgtcgaattccactccgaccacatgaagatcagaaacgccactttcccaggtgtccaaatgaaattcgttttgcaaaagttgttgaccactattgctgacgccgctaagggttacaagccagttgctgtcccagctagaactccagctaacgctgctgtcccagcttctaccccattgaagcaagaatggatgtggaaccaattgggtaacttcttgcaagaaggtgatgttgtcattgctgaaaccggtacctccgctttcggtatcaaccaaaccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 304 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 305 - DNA, 1692 bp, Saccharomyces cerevisiaee
  CDS (1)..(1692)
atgtctgaaataaccttaggtaaatatttatttgaaagattgagccaagtcaactgtaacaccgtcttcggtttgccaggtgactttaacttgtctcttttggataagctttatgaagtcaaaggtatgagatgggctggtaacgctaacgaattgaacgctgcctatgctgctgatggttacgctcgtatcaagggtatgtcctgtattattaccaccttcggtgttggtgaattgtctgctttgaatggtattgccggttcttacgctgaacatgtcggtgttttgcacgttgttggtgttccatccatctcttctcaagctaagcaattgttgttgcatcataccttgggtaacggtgacttcactgttttccacagaatgtctgccaacatttctgaaaccactgccatgatcactgatattgctaacgctccagctgaaattgacagatgtatcagaaccacctacactacccaaagaccagtctacttgggtttgccagctaacttggttgacttgaacgtcccagccaagttattggaaactccaattgacttgtctttgaagccaaacgacgctgaagctgaagctgaagttgttagaactgttgttgaattgatcaaggatgctaagaacccagttatcttggctgatgcttgtgcttctagacatgatgtcaaggctgaaactaagaagttgatggacttgactcaattcccagtttacgtcaccccaatgggtaagggtgctattgacgaacaacacccaagatacggtggtgtttacgttggtaccttgtctagaccagaagttaagaaggctgtagaatctgctgatttgatattgtctatcggtgctttgttgtctgatttcaataccggttctttctcttactcctacaagaccaaaaatatcgttgaattccactctgaccacatcaagatcagaaacgccaccttcccaggtgttcaaatgaaatttgccttgcaaaaattgttggatgctattccagaagtcgtcaaggactacaaacctgttgctgtcccagctagagttccaattaccaagtctactccagctaacactccaatgaagcaagaatggatgtggaaccatttgggtaacttcttgagagaaggtgatattgttattgctgaaaccggtacttccgccttcggtattaaccaaactactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 306 - protein, 563 aa, Saccharomyces cerevisiaee
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 307 - DNA, 1599 bp, Saccharomyces cerevisiae
  CDS (1)..(1599)
atgtctgaaattactcttggaaaatacttatttgaaagattgaagcaagttaatgttaacaccatttttgggctaccaggcgacttcaacttgtccctattggacaagatttacgaggtagatggattgagatgggctggtaatgcaaatgagctgaacgccgcctatgccgccgatggttacgcacgcatcaagggtttatctgtgctggtaactacttttggcgtaggtgaattatccgccttgaatggtattgcaggatcgtatgcagaacacgtcggtgtactgcatgttgttggtgtcccctctatctccgctcaggctaagcaattgttgttgcatcataccttgggtaacggtgattttaccgtttttcacagaatgtccgccaatatctcagaaactacatcaatgattacagacattgctacagccccttcagaaatcgataggttgatcaggacaacatttataacacaaaggcctagctacttggggttgccagcgaatttggtagatctaaaggttcctggttctcttttggaaaaaccgattgatctatcattaaaacctaacgatcccgaagctgaaaaggaagttattgataccgtactagaattgatccagaattcgaaaaaccctgttatactatcggatgcctgtgcttctaggcacaacgttaaaaaagaaacccagaagttaattgatttgacgcaattcccagcttttgtgacacctctaggtaaagggtcaatagatgaacagcatcccagatatggcggtgtttatgtgggaacgctgtccaaacaagacgtgaaacaggccgttgagtcggctgatttgatcctttcggtcggtgctttgctctctgattttaacacaggttcgttttcctactcctacaagactaaaaatgtagtggagtttcattccgattacgtaaaggtgaagaacgctacgttcctcggtgtacaaatgaaatttgcactacaaaacttactgaaggttattcccgatgttgttaagggctacaagagcgttcccgtaccaaccaaaactcccgcaaacaaaggtgtacctgctagcacgcccttgaaacaagagtggttgtggaacgaattgtccaaattcttgcaagaaggtgatgttatcatttccgagaccggcacgtctgccttcggtatcaatcaaactatctttcctaaggacgcctacggtatctcgcaggtgttgtgggggtccatcggttttacaacaggagcaactttaggtgctgcctttgccgctgaggagattgaccccaacaagagagtcatcttattcataggtgacgggtctttgcagttaaccgtccaagaaatctccaccatgatcagatgggggttaaagccgtatctttttgtccttaacaacgacggctacactatcgaaaagctgattcatgggcctcacgcagagtacaacgaaatccagacctgggatcacctcgccctgttgcccgcatttggtgcgaaaaagtacgaaaatcacaagatcgccactacgggtgagtgggatgccttaaccactgattcagagttccagaaaaactcggtgatc

SEQ ID NO: 308 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 309 - DNA, 1695 bp, Candida glabrata
  CDS (1)..(1695)
atgtctgagattactttgggtagatacttgttcgagagattgaaccaagtcgacgttaagaccatcttcggtttgccaggtgacttcaacttgtccctattggacaagatctacgaagttgaaggtatgagatgggctggtaacgctaacgaattgaacgctgcttacgctgctgacggttacgctagaatcaagggtatgtcctgtatcatcaccaccttcggtgtcggtgaattgtctgccttgaacggtattgccggttcttacgctgaacacgtcggtgtcttgcacgtcgtcggtgtcccatccatctcctctcaagctaagcaattgttgttgcaccacaccttgggtaacggtgacttcactgtcttccacagaatgtccgctaacatctctgagaccaccgctatggtcactgacatcgctaccgctccagctgagatcgacagatgtatcagaaccacctacatcacccaaagaccagtctacttgggtctaccagctaacttggtcgacctaaaggtcccagccaagcttttggaaaccccaattgacttgtccttgaagccaaacgacccagaagccgaaactgaagtcgttgacaccgtcttggaattgatcaaggctgctaagaacccagttatcttggctgatgcttgtgcttccagacacgacgtcaaggctgaaaccaagaagttgattgacgccactcaattcccatccttcgttaccccaatgggtaagggttccatcgacgaacaacacccaagattcggtggtgtctacgtcggtaccttgtccagaccagaagttaaggaagctgttgaatccgctgacttgatcttgtctgtcggtgctttgttgtccgatttcaacactggttctttctcttactcttacaagaccaagaacatcgtcgaattccactctgactacatcaagatcagaaacgctaccttcccaggtgtccaaatgaagttcgctttgcaaaagttgttgaacgccgtcccagaagctatcaagggttacaagccagtccctgtcccagctagagtcccagaaaacaagtcctgtgacccagctaccccattgaagcaagaatggatgtggaaccaagtttccaagttcttgcaagaaggtgatgttgttatcactgaaaccggtacctccgcttttggtatcaaccaaaccccattcccaaacaacgcttacggtatctcccaagttctatggggttccatcggtttcaccaccggtgcttgtttgggtgccgctttcgctgctgaagaaatcgacccaaagaagagagttatcttgttcattggtgacggttctttgcaattgactgtccaagaaatctccaccatgatcagatggggcttgaagccatacttgttcgtcttgaacaacgacggttacaccatcgaaagattgattcacggtgaaaaggctggttacaacgacatccaaaactgggaccacttggctctattgccaaccttcggtgctaaggactacgaaaaccacagagtcgccaccaccggtgaatgggacaagttgacccaagacaaggaattcaacaagaactccaagatcagaatgatcgaagttatgttgccagttatggacgctccaacttccttgattgaacaagctaagttgaccgcttccatcaacgctaagcaagaataa

SEQ ID NO: 310 - protein, 564 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASINAKQE

SEQ ID NO: 311 - DNA, 1791 bp, Pichia stipitis
  CDS (1)..(1791)
atggctgaagtctcattaggaagatatctcttcgagagattgtaccaattgcaagtgcagaccatcttcggtgtccctggtgatttcaacttgtcgcttttggacaagatctacgaagtggaagatgcccatggcaagaattcgtttagatgggctggtaatgccaacgaattgaatgcatcgtacgctgctgacggttactcgagagtcaagcgtttagggtgtttggtcactacctttggtgtcggtgaattgtctgctttgaatggtattgccggttcttatgccgaacatgttggtttgcttcatgtcgtaggtgttccatcgatttcctcgcaagctaagcaattgttacttcaccacactttgggtaatggtgatttcactgttttccatagaatgtccaacaacatttctcagaccacagcctttatctccgatatcaactcggctccagctgaaattgatagatgtatcagagaggcctacgtcaaacaaagaccagtttatatcgggttaccagctaacttagttgatttgaatgttccggcctctttgcttgagtctccaatcaacttgtcgttggaaaagaacgacccagaggctcaagatgaagtcattgactctgtcttagacttgatcaaaaagtcgctgaacccaatcatcttggtcgatgcctgtgcctcgagacatgactgtaaggctgaagttactcagttgattgaacaaacccaattcccagtatttgtcactccaatgggtaaaggtaccgttgatgagggtggtgtagacggagaattgttagaagatgatcctcatttgattgccaaggtcgctgctaggttgtctgctggcaagaacgctgcctctagattcggaggtgtttatgtcggaaccttgtcgaagcccgaagtcaaggacgctgtagagagtgcagatttgattttgtctgtcggtgcccttttgtctgatttcaacactggttcattttcctactcctacagaaccaagaacatcgtcgaattccattctgattacactaagattagacaagccactttcccaggtgtgcagatgaaggaagccttgcaagaattgaacaagaaagtttcatctgctgctagtcactatgaagtcaagcctgtgcccaagatcaagttggccaatacaccagccaccagagaagtcaagttaactcaggaatggttgtggaccagagtgtcttcgtggttcagagaaggtgatattattatcaccgaaaccggtacatcctccttcggtatagttcaatccagattcccaaacaacaccatcggtatctcccaagtattgtggggttctattggtttctctgttggtgccactttgggtgctgccatggctgcccaagaactcgaccctaacaagagaaccatcttgtttgttggagatggttctttgcaattgaccgttcaggaaatctccaccataatcagatggggtaccacaccttaccttttcgtgttgaacaatgacggttacaccatcgagcgtttgatccacggtgtaaatgcctcatataatgacatccaaccatggcaaaacttggaaatcttgcctactttctcggccaagaactacgacgctgtgagaatctccaacatcggagaagcagaagatatcttgaaagacaaggaattcggaaagaactccaagattagattgatagaagtcatgttaccaagattggatgcaccatctaaccttgccaaacaagctgccattacagctgccaccaacgccgaagcttag

SEQ ID NO: 312 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSLNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 313 - DNA, 1710 bp, Pichia stipitis
  CDS (1)..(1710)
atggtatcaacctacccagaatcagaggttactctaggaaggtacctctttgagcgactccaccaattgaaagtggacaccattttcggcttgccgggtgacttcaacctttccttattggacaaagtgtatgaagttccggatatgaggtgggctggaaatgccaacgaattgaatgctgcctatgctgccgatggttactccagaataaagggattgtcttgcttggtcacaacttttggtgttggtgaattgtctgctttaaacggagttggtggtgcctatgctgaacacgtaggacttctacatgtcgttggagttccatccatatcgtcacaggctaaacagttgttgctccaccataccttgggtaatggtgacttcactgtttttcacagaatgtccaatagcatttctcaaactacagcatttctctcagatatctctattgcaccaggtcaaatagatagatgcatcagagaagcatatgttcatcagagaccagtttatgttggtttaccggcaaatatggttgatctcaaggttccttctagtctcttagaaactccaattgatttgaaattgaaacaaaatgatcctgaagctcaagaagttgttgaaacagtcctgaagttggtgtcccaagctacaaaccccattatcttggtagacgcttgtgccctcagacacaattgcaaagaggaagtcaaacaattggttgatgccactaattttcaagtctttacaactccaatgggtaaatctggtatctccgaatctcatccaagattgggcggtgtctatgtcgggacaatgtcgagtcctcaagtcaaaaaagccgttgaaaatgccgatcttatactatctgttggttcgttgttatcggacttcaatacaggttcattttcatactcctacaagacgaagaatgttgttgaattccactctgactatatgaaaatcagacaggccaccttcccaggagttcaaatgaaagaagccttgcaacagttgataaaaagggtctcttcttacatcaatccaagctacattcctactcgagttcctaaaaggaaacagccattgaaagctccatcagaagctcctttgacccaagaatatttgtggtctaaagtatccggctggtttagagagggtgatattatcgtaaccgaaactggtacatctgctttcggaattattcaatcccattttcccagcaacactatcggtatatcccaagtcttgtggggctcaattggtttcacagtaggtgcaacagttggtgctgccatggcagcccaggaaatcgaccctagcaggagagtaattttgttcgtcggtgatggttcattgcagttgacggttcaggaaatctctacgttgtgtaaatgggattgtaacaatacttatctttacgtgttgaacaatgatggttacactatagaaaggttgatccacggcaaaagtgccagctacaacgatatacagccttggaaccatttatccttgcttcgcttattcaatgctaagaaataccaaaatgtcagagtatcgactgctggagaattggactctttgttctctgataagaaatttgcttctccagataggataagaatgattgaggtgatgttatcgagattggatgcaccagcaaatcttgttgctcaagcaaagttgtctgaacgggtaaaccttgaaaattga

SEQ ID NO: 314 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 315 - DNA, 1692 bp, Kluyveromyces lactis
  CDS (1)..(1692)
atgtctgaaattacattaggtcgttacttgttcgaaagattaaagcaagtcgaagttcaaaccatctttggtctaccaggtgatttcaacttgtccctattggacaatatctacgaagtcccaggtatgagatgggctggtaatgccaacgaattgaacgctgcttacgctgctgatggttacgccagattaaagggtatgtcctgtatcatcaccaccttcggtgtcggtgaattgtctgctttgaacggtattgccggttcttacgctgaacacgttggtgtcttgcacgttgtcggtgttccatccgtctcttctcaagctaagcaattgttgttgcaccacaccttgggtaacggtgacttcactgttttccacagaatgtcctccaacatttctgaaaccactgctatgatcaccgatatcaacactgccccagctgaaatcgacagatgtatcagaaccacttacgtttcccaaagaccagtctacttgggtttgccagctaacttggtcgacttgactgtcccagcttctttgttggacactccaattgatttgagcttgaagccaaatgacccagaagccgaagaagaagtcatcgaaaacgtcttgcaactgatcaaggaagctaagaacccagttatcttggctgatgcttgttgttccagacacgatgccaaggctgagaccaagaagttgatcgacttgactcaattcccagccttcgttaccccaatgggtaagggttccattgacgaaaagcacccaagattcggtggtgtctacgtcggtaccctatcttctccagctgtcaaggaagccgttgaatctgctgacttggttctatcggtcggtgctctattgtccgatttcaacactggttctttctcttactcttacaagaccaagaacattgtcgaattccactctgactacaccaagatcagaagcgctaccttcccaggtgtccaaatgaagttcgctttacaaaaattgttgactaaggttgccgatgctgctaagggttacaagccagttccagttccatctgaaccagaacacaacgaagctgtcgctgactccactccattgaagcaagaatgggtctggactcaagtcggtgaattcttgagagaaggtgatgttgttatcactgaaaccggtacctctgccttcggtatcaaccaaactcatttcccaaacaacacatacggtatctctcaagttttatggggttccattggtttcaccactggtgctaccttgggtgctgccttcgctgccgaagaaattgatccaaagaagagagttatcttattcattggtgacggttctttgcaattgactgttcaagaaatctccaccatgatcagatggggcttgaagccatacttgttcgtattgaacaacgacggttacaccattgaaagattgattcacggtgaaaccgctcaatacaactgtatccaaaactggcaacacttggaattattgccaactttcggtgccaaggactacgaagctgtcagagtttccaccactggtgaatggaacaagttgaccactgacgaaaagttccaagacaacaccagaatcagattgatcgaagttatgttgccaactatggatgctccatctaacttggttaagcaagctcaattgactgctgctaccaacgctaagaactaa

SEQ ID NO: 316 - protein, 563 aa, Kluyveromyces lactis
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 317 - DNA, 1716 bp, Yarrowia lipolytica
  CDS (1)..(1716)
atgagcgactccgaaccccaaatggtcgacctgggcgactatctctttgcccgattcaagcagctaggcgtggactccgtctttggagtgcccggcgacttcaacctcaccctgttggaccacgtgtacaatgtcgacatgcggtgggttgggaacacaaacgagctgaatgccggctactcggccgacggctactcccgggtcaagcggctggcatgtcttgtcaccacctttggcgtgggagagctgtctgccgtggctgctgtggcaggctcgtacgccgagcatgtgggcgtggtgcatgttgtgggcgttcccagcacctctgctgagaacaagcatctgctgctgcaccacacactcggtaacggcgacttccgggtctttgcccagatgtccaaactcatctccgagtacacccaccatattgaggaccccagcgaggctgccgacgtaatcgacaccgccatccgaatcgcctacacccaccagcggcccgtttacattgctgtgccctccaacttctccgaggtcgatattgccgaccaggctagactggatacccccctggacctttcgctgcagcccaacgaccccgagagccagtacgaggtgattgaggagatttgctcgcgtatcaaggccgccaagaagcccgtgattctcgtcgacgcctgcgcttcgcgatacagatgtgtggacgagaccaaggagctggccaagatcaccaactttgcctactttgtcactcccatgggtaagggttctgtggacgaggatactgaccggtacggaggaacatacgtcggatcgctgactgctcctgctactgccgaggtggttgagacagctgatctcatcatctccgtaggagctcttctgtcggacttcaacaccggttccttctcgtactcctactccaccaaaaacgtggtggaattgcattcggaccacgtcaaaatcaagtccgccacctacaacaacgtcggcatgaaaatgctgttcccgcccctgctcgaagccgtcaagaaactggttgccgagacccctgactttgcatccaaggctctggctgttcccgacaccactcccaagatccccgaggtacccgatgatcacattacgacccaggcatggctgtggcagcgtctcagttactttctgaggcccaccgacatcgtggtcaccgagaccggaacctcgtcctttggaatcatccagaccaagttcccccacaacgtccgaggtatctcgcaggtgctgtggggctctattggatactcggtgggagcagcctgtggagcctccattgctgcacaggagattgacccccagcagcgagtgattctgtttgtgggcgacggctctcttcagctgacggtgaccgagatctcgtgcatgatccgcaacaacgtcaagccgtacatttttgtgctcaacaacgacggctacaccatcgagaggctcattcacggcgaaaacgcctcgtacaacgatgtgcacatgtggaagtactccaagattctcgacacgttcaacgccaaggcccacgagtcgattgtggtcaacaccaagggcgagatggacgctctgttcgacaacgaagagtttgccaagcccgacaagatccggctcattgaggtcatgtgcgacaagatggacgcgcctgcctcgttgatcaagcaggctgagctctctgccaagaccaacgtttag

SEQ ID NO: 318 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 319 - DNA, 1716 bp, Schizosaccharomyces pombe
  CDS (1)..(1716)
atgagtggggatattttagtcggtgaatatctattcaaaaggcttgaacaattaggggtcaagtccattcttggtgttccaggagatttcaatttagctctacttgacttaattgagaaagttggagatgagaaatttcgttgggttggcaataccaatgagttgaatggtgcttatgccgctgatggttatgctcgtgttaatggtctttcagccattgttacaacgttcggcgtgggagagctttccgctattaatggagtggcaggttcttatgcggagcatgtcccagtagttcatattgttggaatgccttccacaaaggtgcaagatactggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaatga

SEQ ID NO: 320 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 321 - DNA, 2145 bp, artificial sequence
  synthetic construct
gcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggt

SEQ ID NO: 322 - DNA, 8994 bp, artificial sequence
  synthetic construct
ctagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgcatgcttgcatttagtcgtgcaatgtatgactttaagatttgtgagcaggaagaaaagggagaatcttctaacgataaacccttgaaaaactgggtagactacgctatgttgagttgctacgcaggctgcacaattacacgagaatgctcccgcctaggatttaaggctaagggacgtgcaatgcagacgacagatctaaatgaccgtgtcggtgaagtgttcgccaaacttttcggttaacacatgcagtgatgcacgcgcgatggtgctaagttacatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttcttaattctgttgtaattaccttcctttgtaattttttttgtaattattcttcttaataatccaaacaaacacacatattacaatagctagctgaggatgaaggcattagtttatcatggggatcacaaaatttcgttagaagacaaaccaaaacccactctgcagaaaccaacagacgttgtggttagggtgttgaaaacaacaatttgcggtactgacttgggaatatacaaaggtaagaatcctgaagtggcagatggcagaatcctgggtcatgagggcgttggcgtcattgaagaagtgggcgaatccgtgacacaattcaaaaagggggataaagttttaatctcctgcgttactagctgtggatcgtgtgattattgcaagaagcaactgtattcacactgtagagacggtggctggattttaggttacatgatcgacggtgtccaagccgaatacgtcagaataccacatgctgacaattcattgtataagatcccgcaaactatcgatgatgaaattgcagtactactgtccgatattttacctactggacatgaaattggtgttcaatatggtaacgttcaaccaggcgatgctgtagcaattgtaggagcaggtcctgttggaatgtcagttttgttaactgctcaattttactcgcctagtaccattattgttatcgacatggacgaaaaccgtttacaattagcgaaggagcttggggccacacacactattaactccggtactgaaaatgttgtcgaagctgtgcatcgtatagcagccgaaggagtggatgtagcaatagaagctgttggtatacccgcaacctgggacatctgtcaggaaattgtaaaacccggcgctcatattgccaacgtgggagttcatggtgttaaggtggactttgaaattcaaaagttgtggattaagaatctaaccatcaccactggtttggttaacactaatactaccccaatgttgatgaaggtagcctctactgataaattgcctttaaagaaaatgattactcacaggtttgagttagctgaaatcgaacacgcatatcaggttttcttgaatggcgctaaagaaaaagctatgaagattattctatctaatgcaggtgccgcctaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggta

SEQ ID NO: 323 - DNA, 4280 bp, artificial sequence
  synthetic construct
ggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccccggctctgagacagtagtaggttagtcatcgctctaccgacgcgcaggaaaagaaagaagcattgcggattacgtattctaatgttcagcccgcggaacgccagcaaatcaccacccatgcgcatgatactgagtcttgtacacgctgggcttccagtgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcttcagcccgcggaacgccagcaaatcaccacccatgcgcatgatactgagtcttgtacacgctgggcttccagtgatgatacaacgagttagccaaggtgagcacggatgtctaaattagaattacgttttaatatctttttttccatatctagggctag

SEQ ID NO: 324 - DNA, 30 bp, artificial sequence
  primer
gcatgcttgcatttagtcgtgcaatgtatg

SEQ ID NO: 325 - DNA, 54 bp, artificial sequence
  primer
gaacattagaatacgtaatccgcaatgcactagtaccacaggtgttgtcctctg

SEQ ID NO: 326 - DNA, 54 bp, artificial sequence
  primer
cagaggacaacacctgtggtactagtgcattgcggattacgtattctaatgttc

SEQ ID NO: 327 - DNA, 28 bp, artificial sequence
  primer
caccttggctaactcgttgtatcatcac

SEQ ID NO: 328 - DNA, 100 bp, artificial sequence
  primer
ttttaagccgaatgagtgacagaaaaagcccacaacttatcaagtgatattgaacaaagggcgaaacttcgcatgcttgcatttagtcgtgcaatgtatg

SEQ ID NO: 329 - DNA, 98 bp, artificial sequence
  primer
cccaattggtaaatattcaacaagagacgcgcagtacgtaacatgcgaattgcgtaattcacggcgataacaccttggctaactcgttgtatcatcac

SEQ ID NO: 330 - DNA, 29 bp, artificial sequence
  primer
caaaagcccatgtcccacaccaaaggatg

SEQ ID NO: 331 - DNA, 26 bp, artificial sequence
  primer
caccatcgcgcgtgcatcactgcatg

SEQ ID NO: 332 - DNA, 28 bp, artificial sequence
  primer
tcggtttttgcaatatgacctgtgggcc

SEQ ID NO: 333 - DNA, 22 bp, artificial sequence
  primer
gagaagatgcggccagcaaaac

SEQ ID NO: 334 - DNA, 2745 bp, artificial sequence
  synthetic construct-constructed coding region-terminator segment
atgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaa

SEQ ID NO: 335 - DNA, 99 bp, artificial sequence
  primer
tcctttctcaattattattttctactcataacctcacgcaaaataacacagtcaaatcaatcaaagtatgactgacaaaaaaactcttaaagacttaag

SEQ ID NO: 336 - DNA, 77 bp, artificial sequence
  primer
gaacattagaatacgtaatccgcaatgcttctttcttttccgtttaacgtatagacttctaatatatttctccatac

SEQ ID NO: 337 - DNA, 45 bp, artificial sequence
  primer
aaacggaaaagaaagaagcattgcggattacgtattctaatgttc

SEQ ID NO: 338 - DNA, 88 bp, artificial sequence
  primer
tatttttcgttacataaaaatgcttataaaactttaactaataattagagattaaatcgccaccttggctaactcgttgtatcatcac

SEQ ID NO: 339 - DNA, 27 bp, artificial sequence
  primer
gacttttggaagcctgaagaaactggc

SEQ ID NO: 340 - DNA, 20 bp, artificial sequence
  primer
cttggcagcaacaggactag

SEQ ID NO: 341 - DNA, 26 bp, artificial sequence
  primer
ccaggccaattcaacagactgtcggc

SEQ ID NO: 342 - DNA, 2347 bp, artificial sequence
  synthetic construct-constructed URA3 marker with flanking homologous repeat sequences for HIS gene replacement and marker excision
gcattgcggattacgtattctaatgttcaggtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatggtacctactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatctctagagtgctggaagaagagctgcttaaccgccgcgcccagggtgaagatccacgctactttaccctgcgtcgtctggatttcggcggctgtcgtctttcgctggcaacgccggttgatgaagcctgggacggtccgctctccttaaacggtaaacgtatcgccacctcttatcctcacctgctcaagcgttatctcgaccagaaaggcatctcttttaaatcctgcttactgaacggttctgttgaagtcgccccgcgtgccggactggcggatgcgatttgcgatctggtttccaccggtgccacgctggaagctaacggcctgcgcgaagtcgaagttatctatcgctcgaaagcctgcctgattcaacgcgatggcgaaatggaagaatccaaacagcaactgatcgacaaactgctgacccgtattcagggtgtgatccaggcgcgcgaatcaaaatacatcatgatgcacgcaccgaccgaacgtctggatgaagtcatccagtgatgatacaacgagttagccaaggtg

SEQ ID NO: 343 - DNA, 80 bp, artificial sequence
  primer
cttcgaagaatatactaaaaaatgagcaggcaagataaacgaaggcaaaggcattgcggattacgtattctaatgttcag

SEQ ID NO: 344 - DNA, 80 bp, artificial sequence; identical to SEQ ID NO: 343
  primer

SEQ ID NO: 345 - DNA, 26 bp, artificial sequence
  primer
gacttgaataatgcagcggcgcttgc

SEQ ID NO: 346 - DNA, 30 bp, artificial sequence
  primer
ccaccctcttcaattagctaagatcatagc

SEQ ID NO: 347 - DNA, 25 bp, artificial sequence
  primer
aaaaattgattctcatcgtaaatgc

SEQ ID NO: 348 - DNA, 20 bp, artificial sequence
  primer
ctgcagcgaggagccgtaat

SEQ ID NO: 349 - DNA, 90 bp, artificial sequence
  primer
atggttcatttaggtccaaaaaaaccacaagccagaaagggttccatggccgatgtgccagcattgcggattacgtattctaatgttcag

SEQ ID NO: 350 - DNA, 91 bp, artificial sequence
  primer
ttaagcaccgatgataccaacggacttaccttcagcaattcttttttgggccaaagcagccaccttggctaactcgttgtatcatcactgg

SEQ ID NO: 351 - DNA, 24 bp, artificial sequence
  primer
ctaggatgagtagcagcacgttcc

SEQ ID NO: 352 - DNA, 26 bp, artificial sequence
  primer
ccaattccgtgatgtctctttgttgc

SEQ ID NO: 353 - skipped

SEQ ID NO: 354 - DNA, 20 bp, artificial sequence
  primer
gtgaacgagttcacaaccgc

SEQ ID NO: 355 - DNA, 22 bp, artificial sequence
  primer
gttcgttccagaattatcacgc

SEQ ID NO: 356 - DNA, 90 bp, Artificial sequence
  Primer
gtattttggtagattcaattctctttccctttccttttccttcgctccccttccttatcagcattgcggattacgtattctaatgttcag

SEQ ID NO: 357 - DNA, 90 bp, Artificial sequence
  Primer
ttggttgggggaaaaagaggcaacaggaaagatcagagggggagggggggggagagtgtcaccttggctaactcgttgtatcatcactgg

SEQ ID NO: 358 - DNA, 4236 bp, artificial sequence
  synthetic construct
gatccgcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 359 - DNA, 7523 bp, Artificial sequence
  synthetic construct
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 360 - DNA, 29 bp, Artificial sequence
  Primer
ctcgaaacaataagacgacgatggctctg

SEQ ID NO: 361 - DNA, 29 bp, Artificial sequence
  Primer
gtctagaccagaagttaagaaggctgtag

SEQ ID NO: 362 - DNA, 26 bp, Artificial sequence
  Primer
tagcacccaatagagcgccgactgtg

SEQ ID NO: 363 - DNA, 4519 bp, Artificial sequence
  synthetic construct
caccttggctaactcgttgtatcatcactggataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatctgaacattagaatacgtaatccgcaatgcggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtac

SEQ ID NO: 364 - DNA, 86 bp, Artificial sequence
  Primer
aggataaaaaaagcttgtgaataaaaatctttcgctaaaaatcaatataagaaaatggtacaccttggctaactcgttgtatcatc

SEQ ID NO: 365 - DNA, 90 bp, Artificial sequence
  Primer
tgcatactttatgcgtttatgcgttttgcgccccttggaaaaaaattgattctcatcgtagcattgcggattacgtattctaatgttcag

SEQ ID NO: 366 - DNA, 13114 bp, artificial sequence
  synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgccgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacatgtttaaactttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 367 - DNA, 11856 bp, Artificial sequence
  synthetic construct
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 368 - DNA, 15539 bp, artificial sequence
  synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

What is claimed is:

1. A recombinant yeast host cell comprising genes encoding an engineered isobutanol biosynthetic pathway, wherein said isobutanol biosynthetic pathway increases the production of isobutanol as compared to naturally occurring amounts of isobutanol made by unmodified yeast and comprises the following substrate to product conversions:
   (a) 2,3-dihydroxy-isovalerate to α-ketoisovalerate;
   (b) the α-ketoisovalerate from (a) to isobutyraldehyde; and
   (c) the isobutyraldehyde from (b) to isobutanol,
   wherein
      (i) the substrate to product conversion of step (a) is performed by a recombinantly expressed acetohydroxy acid dehydratase enzyme;
      (ii) substrate to product conversion of step (b) is performed by a recombinantly expressed decarboxylase enzyme; and
      (iii) the substrate to product conversion of step (c) is performed by a recombinantly expressed alcohol dehydrogenase enzyme,
   wherein the recombinantly expressed enzymes of (i) to (iii) are expressed in the cytosol, and wherein said recombinant yeast host cell is capable of producing isobutanol through the substrate to product conversions of (a) to (c).

2. The recombinant yeast host cell of claim 1, wherein the recombinantly expressed acetohydroxy acid dehydratase enzyme lacks a mitochondrial targeting sequence.

3. The recombinant yeast host cell of claim 1, wherein the recombinantly expressed-decarboxylase enzyme
   comprises amino acid sequence SEQ ID NO:8, SEQ ID NO:193, SEQ ID NO: 195 or SEQ ID NO:197.

4. The recombinant yeast host cell of claim 1, wherein the recombinantly expressed decarboxylase enzyme is from *Lactococcus lactis*.

5. A method of producing isobutanol in a fermentation, comprising;
   (a) providing the recombinant yeast host cell according to claim 1; and
   (b) growing the recombinant yeast host cell under conditions where isobutanol is produced through the fermentation.

6. The method of claim 5 further comprising (c) recovering the isobutanol.

7. The method claim 6, further comprising
   (d) providing the isobutanol recovered in (c) wherein fusel oils are also recovered with the isobutanol to produce a fuel additive;
   (e) blending the fuel additive with fossil fuel to provide a biofuel.

8. The method of claim 5 wherein the recombinant yeast host cell is grown in a medium comprising a fermentable carbon substrate selected from the group consisting of monosaccharides, oligosaccharides, polysaccharides, and mixtures thereof.

9. The method of claim 5 wherein the recombinant yeast host cell is grown in a medium comprising a fermentable carbon substrate selected from the group consisting of glucose, sucrose, fructose, and mixtures thereof.

10. The method of claim 6, wherein said recovering is by distillation, liquid-liquid extraction, adsorption, decantation, pervaporation or combinations thereof.

11. The method of claim 6, further comprising removing solids from the fermentation medium.

12. The method of claim 5, wherein the fermentation is industrial fermentation.

13. The method of claim 5, further comprising measuring the growth rate of the recombinant yeast host cell.

14. The recombinant yeast cell of claim 1, wherein said recombinant yeast host cell also produces fusel oils.

15. The recombinant yeast host cell of claim 1 further comprising an inactivated gene thereby reducing yield loss from competing pathways for carbon flow.

16. The recombinant yeast host cell of claim 1, wherein the recombinantly expressed acetohydroxy acid dehydratase enzyme is derived from *Escherichia coli, Bacillus subtilis, Saccharomyces cerevisiae*, or *Methanococcus maripaludis*.

17. The recombinant yeast host cell of claim 1, wherein the recombinantly expressed acetohydroxy acid dehydratase enzyme comprises amino acid sequence SEQ ID NO:6, SEQ ID NO:186, SEQ ID NO:188 or SEQ ID NO:190.

18. The recombinant yeast host cell of claim 1, wherein the recombinantly expressed decarboxylase enzyme comprises amino acid sequence SEQ ID NO:193.

19. The recombinant yeast host cell of claim 1, wherein the recombinantly expressed alcohol dehydrogenase enzyme comprises amino acid sequence SEQ ID NO: 10, SEQ ID NO: 199, SEQ ID NO:201, SEQ ID NO:203, or SEQ ID NO:204.

20. The recombinant yeast host cell of claim 1, wherein the acetohydroxy acid dehydratase enzyme has the EC number 4.2.1.9, the decarboxylase enzyme has the EC number 4.1.1.72, and the alcohol dehydrogenase enzyme has an EC number of 1.1.1.1, 1.1.1.2, or 1.1.1.265.

* * * * *